(12) United States Patent
Weiner et al.

(10) Patent No.: US 8,709,772 B2
(45) Date of Patent: *Apr. 29, 2014

(54) TRANSFERASES AND OXIDOREDUCTASES, NUCLEIC ACIDS ENCODING THEM AND METHODS FOR MAKING AND USING THEM

(75) Inventors: David P. Weiner, San Diego, CA (US); Peter Luginbuhl, San Diego, CA (US); Analia Bueno, San Diego, CA (US); Joslin Cuenca, San Diego, CA (US); Erin Marasco, Minneapolis, MN (US)

(73) Assignee: Verenium Corporation, San Diego, CA (US)

( * ) Notice: Subject to any disclaimer, the term of this patent is extended or adjusted under 35 U.S.C. 154(b) by 440 days.

This patent is subject to a terminal disclaimer.

(21) Appl. No.: 12/810,057

(22) PCT Filed: Dec. 31, 2008

(86) PCT No.: PCT/US2008/088675
§ 371 (c)(1),
(2), (4) Date: Oct. 21, 2010

(87) PCT Pub. No.: WO2009/088949
PCT Pub. Date: Jul. 16, 2009

(65) Prior Publication Data
US 2011/0033391 A1 Feb. 10, 2011

Related U.S. Application Data

(60) Provisional application No. 61/018,868, filed on Jan. 3, 2008.

(51) Int. Cl.
| | | |
|---|---|---|
| *C12N 9/10* | (2006.01) | |
| *C12Q 1/00* | (2006.01) | |
| *C12Q 1/68* | (2006.01) | |
| *C12P 21/06* | (2006.01) | |
| *C12P 21/04* | (2006.01) | |
| *C12N 1/20* | (2006.01) | |
| *C12N 15/00* | (2006.01) | |
| *C12P 7/00* | (2006.01) | |
| *C12P 13/04* | (2006.01) | |
| *C07H 21/04* | (2006.01) | |

(52) U.S. Cl.
USPC .............. 435/193; 435/4; 435/6.1; 435/69.1; 435/71.1; 435/252.3; 435/320.1; 435/132; 435/106; 435/440; 536/23.2

(58) Field of Classification Search
None
See application file for complete search history.

(56) References Cited

U.S. PATENT DOCUMENTS

| | | |
|---|---|---|
| 5,858,423 A | 1/1999 | Yajima |
| 6,337,190 B1 * | 1/2002 | Hwang et al. ................... 435/47 |
| 2009/0198072 A1 * | 8/2009 | Khare et al. ................... 548/495 |

FOREIGN PATENT DOCUMENTS

| | | |
|---|---|---|
| EP | 0881285 A1 | 12/1998 |
| EP | 1580268 A1 | 9/2005 |
| WO | 2004/085624 A2 | 10/2004 |
| WO | 200609652 | 9/2006 |
| WO | 2008/143679 A2 | 11/2008 |
| WO | 2009/088482 A1 | 7/2009 |

OTHER PUBLICATIONS

Branden et al. Introduction to Protein Structure, Garland Publishing Inc., New York, p. 247, 1991.*
PCT/US2008/088675—ISR & WO—Mar. 24, 2009.
PCT/US2008/088675—IPRP—Jul. 15, 2010.
SIPO—Office Action—Jul. 7, 2011—200880127771.X.
Yamaguchi—"Isolation and Purificatioin of Blasticidin S Deaminase from Aspergillus Terreus"—Journal of Antibiotic Research (1975)—28—7-14.
EPO—EP08869698.4—Extended EP Search Report—Nov. 14, 2011.
SUGIO—Biochemistry (1995)—34—9661-9669.
UNIPROT Accession No. A6LX33 (Jul. 27, 2007)—Copeland.

* cited by examiner

*Primary Examiner* — Yong Pak
(74) *Attorney, Agent, or Firm* — Brian W. Siddons; Verenium Corporation

(57) ABSTRACT

This invention relates generally to enzymes, polynucleotides encoding the enzymes, the use of such polynucleotides and polypeptides and more specifically to enzymes having transferase activity, e.g., transaminase activity, e.g., d-amino-acid transferase activity, and/or oxidoreductase activity, e.g., dehydrogenase activity, e.g., damino-acid dehydrogenase activity, and/or catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+$H_2O$+acceptor<=>a 2-oxo acid+$NH_3$+reduced acceptor. Thus, the invention provides enzymes, compositions, methods for production of pharmaceutical compositions, pharmaceutical intermediates, antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention.

26 Claims, 10 Drawing Sheets

Figure 5

```
SEQ ID NO:894    MDALGYYNGKWGPLDEMTVPMNDRGCFFGDGVYDATIAANGVIFALDEHIDRFLNSAKLLEIEIGFTKEELKKTFFEM--
SEQ ID NO:1066   MENLGYYNGKFGLLEEMTVPMLDRVCYFGDGVYDATYSRNHKIFALEEHIDRFYNSAGLLGIKIPYSKEQVKEILKEM--
SEQ ID NO:1064   MKDLGYYNGEYDLIENMKIPMNDRVCYFGDGVYDATYSRNHNIFALDEHIDRFYNSAELLRIKIPYTKKEMKELLKDM--
SEQ ID NO:1068   MKQVGYYNGTIADLNELKVPATDRALYFGDGCYDATTFKNNVAFALEDHLDRFYNSCRLLEIDFPLNRDELKEKLYAVID

SEQ ID NO:894    HSKVDKGVYMVYWQATRGTGRRSHVFPAG--P--S-NLWIMIKPNHVDDLYRKIKLITMEDTRFLHCNIKTLNLIPNVIA
SEQ ID NO:1066   VLKVDSGEQFVYWQITRGTGMRNHAFPGDEVP--S-NLWIMLKPLNIKDMSQKLKLITLEDTRFLHCNIKTLNLLPSVIA
SEQ ID NO:1064   VKKVDSGEQFVYWQVTRGTGMRNHAFLSE--DKVA-NIWIVLKPLKVKDMSKKLKLITLEDTRFLHCNIKTLNLLPSVIA
SEQ ID NO:1068   ANEVDTGI--LYWQTSRGSGLRNHIFPED---S--QPNLLIFTAPYGLVPFDTEYKLISREDTRFLHCNIKTLNLLPNVIA

SEQ ID NO:894    SQRALEAGCHEAVFHRGETVTECAHSNVHIIKNGRFITHQADNLLILRGIARSHLLQACIRLNIPFDEREFTLSELFDADE
SEQ ID NO:1066   SQKTEEAGCQEAVFHRGDRVTECAHSNVSIIKDGILKTAPTDNLLILPGIARAHLIKMCKSFNIPVDETAFTLKELMEADE
SEQ ID NO:1064   AQKTEEAGCQEAVFHRGDRVTECAHSNVSIIKDEILKTAPTDNLLILPGIARAHLIKMCKKFEIPVDETPFTLKELINADE
SEQ ID NO:1068   SQKANESHCQEVVFHRGDRVTECAHSNLILLKDGVLCSPPRDNLLILPGITLKHLLQLAKENNIPTSEAPFTMDDLRNADE

SEQ ID NO:894    ILVSSSGTLGLSANTIDGKNVGGKAPELLKKIQGEVLREFIEATGYTPEWSTV*
SEQ ID NO:1066   VIVTSSGQFCMATSEIDGIPVGGKAPELVKKLQDALLNEFLEETKTE-------
SEQ ID NO:1064   VIVTSSGQFCMTACEIDGRPVGGKAPDIIKKLQTALLNEFLEETN---------
SEQ ID NO:1068   VIVSSSACLGIRAVELDGQPVGGKDGKTLKILQDAYAKKYNAETVSR-------
```

Fig. 6A

```
                                      10        20        30        40        50        60        70        80
                              ....|....|....|....|....|....|....|....|....|....|....|....|....|....|....|....|
B_macerans_DAT                MAYSLWNDQIVEEGSIAISPEDRGYQFGDGIYEVIKVYNGNMFTAQEHIDRFYASAEKIRLVIPYTKDVLHKLLHELIEK
SEQ ID NO:910                 MAYSLWNDQIVEEGSIAVSPEDRGYQFGDGIYEVIKVYNGNMFTAQEHIDRFYASAEKIRLVIPYTKDVLHKLLHELIEK
B_sphaericus_DAT              MAYSLWNDQIVEEGSITISPEDRGYQFGDGIYEVIKVYNGHMFTAQEHIDRFYASAEKIRLVIPYTKDVLHKLLHDLIEK
Hybrid_DAT                    MGYTLWNDQIVEDGSVSISPEDRGYQFGDGVYEVVKVYNGNMFTVNEHIDRLYASAEKIRIVIPYTKDVFHKLLHELVEK
B_rotans_ATCC_4978_DAT        MSYSLWNDQIVNDEEVVVDKEDRGYQFGDGVYEVVKVYNGELFTAEEHVDRFYASAEKIRVTIPYTKDKLHQLLHQLVEM
G_stearothermophilus_DAT      MGYTLWNDQIVKDEEVKIDKEDRGYQFGDGVYEVVKVYNGEMFTVNEHIDRLYASAEKIRITIPYTKDKFHQLLHELVEK
B_serositidis_ATCC_7063_DAT   MSYTLWNDKIVDDNQVFINKEDRGYQFGDGVYEVIKVYDGEMFTATEHIDRFYASAEKIKLTVPYTKHKLHQLLHELVEA
SEQ ID NO:870                 MYSLWNDQIVKDEEVKIDKEDRGYQFGDGIYEVIKVYDGEMFTAEEHIDRFYECAEKIRLTIPYTKHKLHQLLHQLVEA 90       100       110       120       130       140       150       160
                              ....|....|....|....|....|....|....|....|....|....|....|....|....|....|....|....|
B_macerans_DAT                NNLETGHVYFQITRGANSRNHVFPDASIPAVLTGNVKAGERAYENFEKGVKATFVEDIRWLRCDIKSLNLLGAVLAKQEA
SEQ ID NO:910                 NNLDTGHVYFQITRGANSRNHVFPDASVPAVLTGNVKAGERAYENFEKGVKATFVEDIRWLRCDIKSLNLLGAVLAKQEA
B_sphaericus_DAT              NNLNTGHVYFQITRGTTSRNHIFPDASVPAVLTGNVKTGERSIENFEKGVKATLVEDVRWLRCDIKSLNLLGAVLAKQEA
Hybrid_DAT                    NNLNTGHIYFQVTRGTSSRAHVFPEATVPAVITGNVKSGERALENLEKGVKATFVEDIRWLRCDIKSLNLLGAVLAKQEA
B_rotans_ATCC_4978_DAT        NKVQTGHIYFQITRGAGPRNHIFPGDEVKPVLTGNTKENPRPVANFEKGVKATFVEDIRWLRCDIKSLNLLGAVLAKQEA
G_stearothermophilus_DAT      NELNTGHIYFQVTRGTSPRAHQFPENTVKPVIIGYTKENPRPLENLEKGVKATFVEDIRWLRCDIKSLNLLGAVLAKQEA
B_serositidis_ATCC_7063_DAT   NELKTGNLYFQITRGASPRNHLFPGDDVLPVLTGNVKEAPRSIENAQKGVKATFAEDIRWLRCDIKSLNLLGAVLAKQEA
SEQ ID NO:870                 NELKTGHIYFQITRGVASRVHNFPAGNVQPVLSGTTKEFPRPVENFEKGVKATFTEDIRWLRCDIKSLNLLGAVLAKQEA 170       180       190       200       210       220       230       240
                              ....|....|....|....|....|....|....|....|....|....|....|....|....|....|....|....|
B_macerans_DAT                AEKGCYEAILHRGDIVTECSSANVYGIKDGKLYTHPANNFILNGITRQVILKCAEEINLPVIEEPMTKADLLTMDEIIVS
SEQ ID NO:910                 AEKGCYEAILHRGDIVTECSSANVYGIKDGKLYTHPANNFILNGITRQVILKCAEEISLPVVEEPMTKADLLTMDEIIVS
B_sphaericus_DAT              SEKGCYEAILHRGDIITECSSANVYGIKDGKLYTHPANNYILNGITRQVILKCAAEINLPVIEEPMTKGDLLTMDEIIVS
Hybrid_DAT                    SEKGCYEAILHRGDIVTECSSSNVFGIKDGKLYTHPANNLILNGITRQVVIKCAEEINIPVVEEPFTKGEILTMDELFVT
B_rotans_ATCC_4978_DAT        HEKGCYEAVLHRDEIVTEGSSSNIYGIKDGVLYTHPANNFILNGITRQVIIKCAAEIGLPVKEEAMTKTQLLAMDEVIVS
G_stearothermophilus_DAT      HEKGCYEAILHRNNTVTEGSSSNVFGIKDGILYTHPANNMILKGITRDVVIACANEINMPVKEIPFTTHEALKMDELFVT
B_serositidis_ATCC_7063_DAT   HEKGCYEAILHRGETITEGSSTNVFGIKNGVLYTHPADNFILSGITRGVVLACANEIGLPVKQEAFTKDKALQMDEMFVS
SEQ ID NO:870                 IEKGCYEAILHRDGIVTEGSSTNVFGIKNGTLYTHPANNLILRGITRGVILTCAKEIELPVVEQPFTTKQALEMDELFVS
```

Fig. 6B

```
                                         250       260       270       280
                                 ....|....|....|....|....|....|....|....|....|....
B_macerans_DAT                   SVSSEVTPVIDVDGNQIGAGVPGEWTRQLQQSFEAKLPLSMNTK-----    (SEQ ID NO:1126)
SEQ ID NO:910                    SVSSEVTPVIDVDGNQIGAGVPGEWTRKLQQAFEAKLPLSLNTK-----
B_sphaericus_DAT                 SVSSEVTPVIDVDGQQIGAGVPGEWTRKLQKAFEAKLPISINA------    (SEQ ID NO:1127)
Hybrid_DAT                       SVTSEITPVIEIDGNQIGAGVPGEWTRKLQKAFEAKIPLSLNS------    (SEQ ID NO:1128)
B_rotans_ATCC_4978_DAT           STTSEVTPIIDIDGTVIGAGKPGDWTRKLQAQFDTKIPKGIRA------    (SEQ ID NO:1129)
G_stearothermophilus_DAT         STTSEITPVIEIDGKLIRDGKVGEWTRKLQKQFETKIPKPLHI------    (SEQ ID NO:1130)
B_serositidis_ATCC_7063_DAT      STTSEITPVIDLDGVAINGGEIGEWTRKLQKQFATKLPGSPAYNLTEYK    (SEQ ID NO:1131)
SEQ ID NO:870                    STTSEITPVIEIDGVKINNGVIGEWTRKLQKQFETKIP-TPFTNK----
```

Fig. 7A

```
                        10         20         30         40         50         60         70         80
                 ....|....|....|....|....|....|....|....|....|....|....|....|....|....|....|....|
SEQ ID NO:946    MNALGYYNGKWGPLDEMTVPMNDRGCFFGDGVYDATCAANGVIFALDEHIDRFFNSAKLLEIEIGFTKEELKKTINEMYS
SEQ ID NO:894    MDALGYYNGKWGPLDEMTVPMNDRGCFFGDGVYDATIAANGVIFALDEHIDRFLNSAKLLEIEIGFTKEELKKTFFEMHS
SEQ ID NO:892    MDALGYYNGKWGPLDEMTVPMNDRGCYFGDGVYDATIAANGVIFALDEHIDRFFNSSKLLEIKICITKEELKKTLNDMHF
SEQ ID NO:220    MDALGYYNGNWGPLDEMTVPMNDRGCYFGDGVYDATCAVNGVIFALDEHIDRFFNSAKLLEINISLTKEELKKTLNEMYS
SEQ ID NO:176    MDALGYYNGKWGPLDEMTVPMNDRGCYFGDGVYDATCAANGVIFALDEHIDRFFNSAKLLEIEISLTKGELKKTLNEMHS
SEQ ID NO:1064   MKDLGYYNGEYDLIENMKIPMNDRVCYFGDGVYDATYSRNHNIFALDEHIDRFYNSAELLRIKIPYTKKEMKELLKDMVK
SEQ ID NO:1066   MENLGYYNGKFGLLEEMTVPMLDRVCYFGDGVYDATYSRNHKIFALEEHIERFYNSAGLLGIKIPYSKEQVKEILKEMVL
SEQ ID NO:1068   MKQVGYYNGTIADLNELKVPATDRALYFGDGCYDATTFKNNVAFALEDHLDRFYNSCRLLEIDFPLNRDELKEKLYAVID 90        100        110        120        130        140        150        160
                 ....|....|....|....|....|....|....|....|....|....|....|....|....|....|....|....|
SEQ ID NO:946    KVDKGEYQVYWQATRGTGRRSHVFPAG--PSNLWIMIKPNHVDDLYRKIKLITTEDTRFFHCNIKTLNLIPNVIASQRAL
SEQ ID NO:894    KVDKGVYMVYWQATRGTGRRSHVFPAG--PSNLWIMIKPNHVDDLYRKIKLITMEDTRFLHCNIKTLNLIPNVIASQRAL
SEQ ID NO:892    KVDKGVYMVYWQATRGTGRRNHVFPAG--PSNLWIMIKPNHIDDLNKKIKLITTEDTRFLHCNIKTLNLIPNVIASQRAL
SEQ ID NO:220    KVDKGEYLVYWQVTRGTGRRNHVFPAG--PSNLWIIIKPNHIDNLYRKIKLITMDDTRFFHCNIKTLNLIPNVIASQRAL
SEQ ID NO:176    KVDKGEYLVYWQTTRGTGRRNHVFPAG--PSNLWIMIKPYPIDDLYRKIKLITMEDTRFFHCNIKTLNLIPNVIASQRAL
SEQ ID NO:1064   KVDSGEQFVYWQVTRGTGMRNHAFLSEDVKANIWIVLKPLKVKDMSKKLIKLITLEDTRFLHCNIKTLNLLPSVIAAQKTE
SEQ ID NO:1066   KVDSGEQFVYWQITRGTGMRNHAFPGDEVPANLWIMLKPLNIKDMSQKLKLITLEDTRFLHCNIKTLNLLPSVIASQKTE
SEQ ID NO:1068   ANEVDTGILYWQTSRGSGLRNHIFPEDS-QPNLLIFTAPYGLVPFDTEYKLISREDTRFLHCNIKTLNLIPNVIASQKAN 170        180        190        200        210        220        230        240
                 ....|....|....|....|....|....|....|....|....|....|....|....|....|....|....|....|
SEQ ID NO:946    EAGCHEAVFHRGETVTECAHSNVHIIKDGRFITHQTDNLILPGIARSHLLQACDRLNVPVDEREFTLSELFGADEVIVSS
SEQ ID NO:894    EAGCHEAVFHRGETVTECAHSNVHIIKNGRFITHQADNLILRGIARSHLLQACIRLNIPFDEREFTLSELFDADEILVSS
SEQ ID NO:892    EAGCQEAVFHRGETVTECAHSNVHIIKNGRFITHQADNLILRGIARSHLLQACDRLNVPVDEREFTLPELFDADEVLVSS
SEQ ID NO:220    EAGCHEAVFHRGETVTECAHSNVHIIKNGRFITHPADNLILRGTARSHLLQACVRLNIPVDEREFSLSELFDADEVIVSS
SEQ ID NO:176    EVGCHEAVFHRGETVTECAHSNVHIIRNGRFITHQADNLILRGIARSHLLQACVRLNIPVDEREFTLSELFDADEVIVSS
SEQ ID NO:1064   EAGCQEAVFHRGDRVTECAHSNVSIIKDEILKTAPTDNLILPGIARAHLIKMCKKFEIPVDETPFTLKELINADEVIVTS
SEQ ID NO:1066   EAGCQEAVFHRGDRVTECAHSNVSIIKDGILKTAPTDNLILPGIARAHLIKMCKSFNIPVDETAFTLKELMEADEVIVTS
SEQ ID NO:1068   ESHCQEVVFHRGDRVTECAHSNILILKDGVLCSPPRDNLILPGITLKHLIQLAKENNIPTSEAPFTMDDLRNADEVIVSS
```

Fig. 7B

```
           250       260       270       280
            |    |    |    |    |    |    |    |
SGTIGLSADTIDGKNVGGKAPELLKRIQDEVLKEFIEATARAEFFG--
SGTIGLSANTIDGKNVGGKAPELLKKIQGEVLREFIEATGYTPEWSTV
SGTFGLSADTIDGKSVGGKAPELLKKIQDEVMREFIEATGYTPEWRKA
SGTIGLSAEEIDGKKAGGKAPELLKKIQDEVLREFIEATGYTPEWSRV
SGTIGLSADTIDGKAVGGKAPELLKKIQDEVLREFTEVTGYKPAWSRV
SGQFCMTACEIDGRPVGGKAPDIIKKLQTALINEFLEETN-------
SGQFCMATSEIDGIPVGGKAPELVKKLQDALINEFLEETKTE-----
SACIGIRAVELDGQPVGGKDGKTLKILQDAYAKKYNAETVSR-----
```

SEQ ID NO:946
SEQ ID NO:894
SEQ ID NO:892
SEQ ID NO:220
SEQ ID NO:176
SEQ ID NO:1064
SEQ ID NO:1066
SEQ ID NO:1068

TRANSFERASES AND OXIDOREDUCTASES, NUCLEIC ACIDS ENCODING THEM AND METHODS FOR MAKING AND USING THEM

CROSS REFERENCE TO RELATED APPLICATIONS

This application is a national stage application claiming the benefit of priority under 35 U.S.C. §371 to Patent Cooperation Treaty (PCT) Application No. PCT/US2008/088675 having an international filing date of Dec. 31, 2008, and published as WO 2009/088949, on Jul. 16, 2009, which claims the benefit of priority under 35 U.S.C. §119(e) to U.S. Provisional Application No. 61/018,868, filed Jan. 3, 2008. The entire content of the above mentioned patent applications are incorporated by reference herein in their entirety and for all purposes.

REFERENCE TO SEQUENCE LISTING SUBMITTED VIA EFS-WEB

This application was filed electronically via the USPTO EFS-WEB server, as authorized and set forth in MPEP §502.05 and this electronic filing includes an electronically submitted sequence (SEQ ID) listing; the entire content of this sequence listing is herein incorporated by reference for all purposes. The sequence listing is identified on the electronically filed ASCII text (.txt) file as follows:

| File Name | Date of Creation | Size |
|---|---|---|
| D1240_13N_SequenceListing.txt | Oct. 20, 2010 | 3.40 MB (3,566,407) bytes |

FIELD OF THE INVENTION

This invention relates generally to enzymes, polynucleotides encoding the enzymes, the use of such polynucleotides and polypeptides and more specifically to enzymes having transferase activity, e.g., transaminase activity, e.g., d-amino-acid transferase activity, and/or oxidoreductase activity, e.g., dehydrogenase activity, e.g., d-amino-acid dehydrogenase activity, and/or catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+$H_2O$+acceptor<=>a 2-oxo acid+$NH_3$+reduced acceptor. Thus, the invention provides enzymes, compositions and/or methods for the production of pharmaceutical (drug) compositions, pharmaceutical (drug) precursors and/or intermediates (including antibiotics) sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention.

BACKGROUND

Transferases and/or oxidoreductases catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+H2O+acceptor<=>a 2-oxo acid+NH3+reduced acceptor. Transferases, e.g., transaminases, e.g., d-amino-acid transferases (also referred to as "d-aminotransferases" or "D-ATs"), and/or oxidoreductases, e.g., dehydrogenases, e.g., d-amino-acid dehydrogenases are of considerable commercial value, being used in the pharmaceutical industry, in the food, feed and beverage industries, e.g. for the production of sweeteners, in the wood/paper industry and in the fuel industry.

SUMMARY OF THE INVENTION

This invention provides enzymes having transferase activity, e.g., transaminase activity, e.g., d-amino-acid transferase activity, and/or oxidoreductase activity, e.g., dehydrogenase activity, e.g., d-amino-acid dehydrogenase activity, and/or catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+$H_2O$+acceptor<=>a 2-oxo acid+$NH_3$+reduced acceptor. The invention further provides enzymes having transferase activity, e.g., transaminase activity, e.g., d-amino-acid transferase activity, and/or oxidoreductase activity, e.g., dehydrogenase activity, e.g., d-amino-acid dehydrogenase activity and nucleic acids encoding them, vectors and cells comprising them, probes for amplifying and identifying these transferase-, e.g., transaminase-, e.g., d-amino-acid transferase-, and/or oxidoreductase-, e.g., dehydrogenase-, e.g., d-amino-acid dehydrogenase-encoding nucleic acids, and methods for making and using these polypeptides and peptides.

The invention provides enzymes, compositions and/or methods for the production of pharmaceutical (drug) compositions, pharmaceutical (drug) precursors and/or intermediates (including antibiotics) sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention. These compositions can be formulated in a variety of forms, such as tablets, gels, pills, implants, liquids, sprays, films, micelles, powders, food, feed pellets or as any type of encapsulated form.

In some embodiments, the transferases, e.g., transaminases, e.g., d-amino-acid transferases, and/or oxidoreductases, e.g., dehydrogenases, e.g., d-amino-acid dehydrogenases and/or compositions thereof may be useful in pharmaceutical, industrial, and/or agricultural contexts.

In some embodiments, the transferases, e.g., transaminases, e.g., d-amino-acid transferases and/or compositions thereof may be useful for catalyzing a reaction between an amino acid and an α-keto acid. In some embodiments, the transferases, e.g., transaminases, e.g., d-amino-acid transferases and/or compositions thereof may be useful for catalyzing a transamination reaction. In some embodiments, the transferases, e.g., transaminases, e.g., d-amino-acid transferases and/or compositions thereof may be useful for catalyzing a reaction that removes the amino group from the amino acid leaving an α-keto acid, and transferring the amino group to a reactant α-keto acid converting it into an amino acid. In alternative embodiments, the transferases, e.g., transaminases, e.g., d-amino-acid transferases and/or compositions thereof may be useful in the production of amino acids.

In some embodiments, the oxidoreductases, e.g., dehydrogenases, e.g., d-amino-acid dehydrogenases and/or compositions thereof may be useful in catalyzing a reaction that oxidizes a substrate by transferring one or more protons and a pair of electrons to an acceptor.

In some embodiments, the oxidoreductases, e.g., dehydrogenases, e.g., d-amino-acid dehydrogenases and/or compositions thereof may be useful in catalyzing a reaction that transfers electrons from one molecule to another. In some embodiments, the oxidoreductase and/or compositions thereof may be useful in catalyzing a reaction that transfers electrons from the reductant to the oxidant.

In some embodiments, transferases, e.g., transaminases, e.g., d-amino-acid transferases are provided that facilitate the production of indole-3-pyruvate. In some embodiments, transferases, e.g., transaminases, e.g., d-amino-acid transferases are provided that facilitate the production of RR-Monatin.

In alternative embodiments, the transferases, e.g., transaminases, e.g., d-amino-acid transferases, and/or oxidoreductases, e.g., dehydrogenases, e.g., d-amino-acid dehydrogenases of the invention and/or compositions thereof may be useful in diagnosing and tracking many diseases, e.g. liver damage/disease or myocardial infarctions. In alternative embodiments, the transferases, e.g., transaminases, e.g., d-amino-acid transferases, and/or oxidoreductases, e.g., dehydrogenases, e.g., d-amino-acid dehydrogenases of the invention and/or combinations thereof are used in pharmaceutical (drug) compositions for the diagnosis, tracking or treatment of any condition and/or disease, e.g. liver damage/disease or myocardial infarctions.

In alternative embodiments, the invention provides enzymes and processes for the bioconversion of any biomass into fuel, e.g. biofuel, e.g., ethanol, propanol, butanol, methanol, and/or biodiesel or biofuels such as synthetic liquids or gases, such as syngas, and the production of other fermentation products, e.g. succinic acid, lactic acid, or acetic acid.

In alternative embodiments, the invention provides polypeptides (and the nucleic acids that encode them) having at least one conservative amino acid substitution and retaining its transferase activity, e.g., transaminase activity, e.g., d-amino-acid transferase activity, and/or oxidoreductase activity, e.g., dehydrogenase activity, e.g., d-amino-acid dehydrogenase activity; or, wherein the at least one conservative amino acid substitution comprises substituting an amino acid with another amino acid of like characteristics; or, a conservative substitution comprises: replacement of an aliphatic amino acid with another aliphatic amino acid; replacement of a serine with a threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;

In alternative embodiments, the invention provides polypeptides (and the nucleic acids that encode them) having a transferase activity, e.g., a transaminase activity, e.g., a d-amino-acid transferase activity or an omega- (or ω-) transaminase activity, and/or an oxidoreductase activity, e.g., a dehydrogenase activity, e.g., a d-amino-acid dehydrogenase activity but lacking a signal sequence, a prepro domain, a binding domain, and/or other domain; and in one aspect, the binding domain comprises, or consists of, a NAD, a NAD(P), a calcium, a thiamine, a FAD, a zinc, a DNA and/or a lipoyl binding domain.

In alternative embodiments, the invention provides polypeptides (and the nucleic acids that encode them) having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity further comprising a heterologous sequence; and in one aspect, the heterologous sequence comprises, or consists of a sequence encoding: (i) a heterologous signal sequence, a heterologous domain, a heterologous binding domain, a heterologous dockerin domain, a heterologous catalytic domain (CD), or a combination thereof; (ii) the sequence of (i), wherein the heterologous signal sequence, binding domain or catalytic domain (CD) is derived from a heterologous enzyme; or, (iii) a tag, an epitope, a targeting peptide, a cleavable sequence, a detectable moiety or an enzyme; and in one aspect, the heterologous binding domain comprises, or consists of, a NAD, a NAD(P), a calcium, a thiamine, a FAD, a zinc, a DNA and/or a lipoyl binding domain; and in one aspect, the heterologous signal sequence targets the encoded protein to a vacuole, the endoplasmic reticulum, a chloroplast or a starch granule.

In alternative embodiments, the invention provides polypeptides (and the nucleic acids that encode them) having a transferase activity, e.g., a transaminase activity, e.g., a d-amino-acid transferase activity or a ω-transaminase activity, or the transaminase activity is an omega transaminase activity that catalyzes the conversion of isobutylamine to isobutyraldehyde; and/or an oxidoreductase activity, e.g., a dehydrogenase activity, e.g., a d-amino-acid dehydrogenase activity, wherein the polypeptides are cofactor dependent or cofactor independent. In one embodiment, a cofactor dependent polypeptide requires the presence of a non-protein component to be functional. In one embodiment, the cofactor comprises a metal ion, a coenzyme, a pyridoxal-phosphate and or a phosphopantetheine.

The invention provides isolated, synthetic or recombinant nucleic acids comprising (a) a nucleic acid (polynucleotide) encoding at least one polypeptide, wherein the nucleic acid comprises a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or complete (100%) sequence identity to the nucleic acid (polynucleotide) sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID
NO:155, SEQ ID NO:157, SEQ ID NO:159, SEQ ID
NO:161, SEQ ID NO:163, SEQ ID NO:165, SEQ ID
NO:167, SEQ ID NO:169, SEQ ID NO:171, SEQ ID
NO:173, SEQ ID NO:175, SEQ ID NO:177, SEQ ID
NO:179, SEQ ID NO:181, SEQ ID NO:183, SEQ ID
NO:185, SEQ ID NO:187, SEQ ID NO:189, SEQ ID
NO:191, SEQ ID NO:193, SEQ ID NO:195, SEQ ID
NO:197, SEQ ID NO:199, SEQ ID NO:201, SEQ ID
NO:203, SEQ ID NO:205, SEQ ID NO:207, SEQ ID
NO:209, SEQ ID NO:211, SEQ ID NO:213, SEQ ID
NO:215, SEQ ID NO:217, SEQ ID NO:219, SEQ ID
NO:221, SEQ ID NO:223, SEQ ID NO:225, SEQ ID
NO:227, SEQ ID NO:229, SEQ ID NO:231, SEQ ID
NO:233, SEQ ID NO:235, SEQ ID NO:237, SEQ ID
NO:239, SEQ ID NO:241, SEQ ID NO:243, SEQ ID
NO:245, SEQ ID NO:247, SEQ ID NO:249, SEQ ID
NO:251, SEQ ID NO:253, SEQ ID NO:255, SEQ ID
NO:257, SEQ ID NO:259, SEQ ID NO:261, SEQ ID
NO:263, SEQ ID NO:265, SEQ ID NO:267, SEQ ID
NO:269, SEQ ID NO:271, SEQ ID NO:273, SEQ ID
NO:275, SEQ ID NO:277, SEQ ID NO:279, SEQ ID
NO:281, SEQ ID NO:283, SEQ ID NO:285, SEQ ID
NO:287, SEQ ID NO:289, SEQ ID NO:291, SEQ ID
NO:293, SEQ ID NO:295, SEQ ID NO:297, SEQ ID
NO:299, SEQ ID NO:301, SEQ ID NO:303, SEQ ID
NO:305, SEQ ID NO:307, SEQ ID NO:309, SEQ ID
NO:311, SEQ ID NO:313, SEQ ID NO:315, SEQ ID
NO:317, SEQ ID NO:319, SEQ ID NO:321, SEQ ID
NO:323, SEQ ID NO:325, SEQ ID NO:327, SEQ ID
NO:329, SEQ ID NO:331, SEQ ID NO:333, SEQ ID
NO:335, SEQ ID NO:337, SEQ ID NO:339, SEQ ID
NO:341, SEQ ID NO:343, SEQ ID NO:345, SEQ ID
NO:347, SEQ ID NO:349, SEQ ID NO:351, SEQ ID
NO:353, SEQ ID NO:355, SEQ ID NO:357, SEQ ID
NO:359, SEQ ID NO:361, SEQ ID NO:363, SEQ ID
NO:365, SEQ ID NO:367, SEQ ID NO:369, SEQ ID
NO:371, SEQ ID NO:373, SEQ ID NO:375, SEQ ID
NO:377, SEQ ID NO:379, SEQ ID NO:381, SEQ ID
NO:383, SEQ ID NO:385, SEQ ID NO:387, SEQ ID
NO:389, SEQ ID NO:391, SEQ ID NO:393, SEQ ID
NO:395, SEQ ID NO:397, SEQ ID NO:399, SEQ ID
NO:401, SEQ ID NO:403, SEQ ID NO:405, SEQ ID
NO:407, SEQ ID NO:409, SEQ ID NO:411, SEQ ID
NO:413, SEQ ID NO:415, SEQ ID NO:417, SEQ ID
NO:419, SEQ ID NO:421, SEQ ID NO:423, SEQ ID
NO:425, SEQ ID NO:427, SEQ ID NO:429, SEQ ID
NO:431, SEQ ID NO:433, SEQ ID NO:435, SEQ ID
NO:437, SEQ ID NO:439, SEQ ID NO:441, SEQ ID
NO:443, SEQ ID NO:445, SEQ ID NO:447, SEQ ID
NO:449, SEQ ID NO:451, SEQ ID NO:453, SEQ ID
NO:455, SEQ ID NO:457, SEQ ID NO:459, SEQ ID
NO:461, SEQ ID NO:463, SEQ ID NO:465, SEQ ID
NO:467, SEQ ID NO:469, SEQ ID NO:471, SEQ ID
NO:473, SEQ ID NO:475, SEQ ID NO:477, SEQ ID
NO:479, SEQ ID NO:481, SEQ ID NO:483, SEQ ID
NO:485, SEQ ID NO:487, SEQ ID NO:489, SEQ ID
NO:491, SEQ ID NO:493, SEQ ID NO:495, SEQ ID
NO:497, SEQ ID NO:499, SEQ ID NO:501, SEQ ID
NO:503, SEQ ID NO:505, SEQ ID NO:507, SEQ ID
NO:509, SEQ ID NO:511, SEQ ID NO:513, SEQ ID
NO:515, SEQ ID NO:517, SEQ ID NO:519, SEQ ID
NO:521, SEQ ID NO:523, SEQ ID NO:525, SEQ ID
NO:527, SEQ ID NO:529, SEQ ID NO:531, SEQ ID
NO:533, SEQ ID NO:535, SEQ ID NO:537, SEQ ID
NO:539, SEQ ID NO:541, SEQ ID NO:543, SEQ ID
NO:545, SEQ ID NO:547, SEQ ID NO:549, SEQ ID
NO:551, SEQ ID NO:553, SEQ ID NO:555, SEQ ID
NO:557, SEQ ID NO:559, SEQ ID NO:561, SEQ ID
NO:563, SEQ ID NO:565, SEQ ID NO:567, SEQ ID
NO:569, SEQ ID NO:571, SEQ ID NO:573, SEQ ID
NO:575, SEQ ID NO:577, SEQ ID NO:579, SEQ ID
NO:581, SEQ ID NO:583, SEQ ID NO:585, SEQ ID
NO:587, SEQ ID NO:589, SEQ ID NO:591, SEQ ID
NO:593, SEQ ID NO:595, SEQ ID NO:597, SEQ ID
NO:599, SEQ ID NO:601, SEQ ID NO:603, SEQ ID
NO:605, SEQ ID NO:607, SEQ ID NO:609, SEQ ID
NO:611, SEQ ID NO:613, SEQ ID NO:615, SEQ ID
NO:617, SEQ ID NO:619, SEQ ID NO:621, SEQ ID
NO:623, SEQ ID NO:625, SEQ ID NO:627, SEQ ID
NO:629, SEQ ID NO:631, SEQ ID NO:633, SEQ ID
NO:635, SEQ ID NO:637, SEQ ID NO:639, SEQ ID
NO:641, SEQ ID NO:643, SEQ ID NO:645, SEQ ID
NO:647, SEQ ID NO:649, SEQ ID NO:651, SEQ ID
NO:653, SEQ ID NO:655, SEQ ID NO:657, SEQ ID
NO:659, SEQ ID NO:661, SEQ ID NO:663, SEQ ID
NO:665, SEQ ID NO:667, SEQ ID NO:669, SEQ ID
NO:671, SEQ ID NO:673, SEQ ID NO:675, SEQ ID
NO:677, SEQ ID NO:679, SEQ ID NO:681, SEQ ID
NO:683, SEQ ID NO:685, SEQ ID NO:687, SEQ ID
NO:689, SEQ ID NO:691, SEQ ID NO:693, SEQ ID
NO:695, SEQ ID NO:697, SEQ ID NO:699, SEQ ID
NO:701, SEQ ID NO:703, SEQ ID NO:705, SEQ ID
NO:707, SEQ ID NO:709, SEQ ID NO:711, SEQ ID
NO:713, SEQ ID NO:715, SEQ ID NO:717, SEQ ID
NO:719, SEQ ID NO:721, SEQ ID NO:723, SEQ ID
NO:725, SEQ ID NO:727, SEQ ID NO:729, SEQ ID
NO:731, SEQ ID NO:733, SEQ ID NO:735, SEQ ID
NO:737, SEQ ID NO:739, SEQ ID NO:741, SEQ ID
NO:743, SEQ ID NO:745, SEQ ID NO:747, SEQ ID
NO:749, SEQ ID NO:751, SEQ ID NO:753, SEQ ID
NO:755, SEQ ID NO:757, SEQ ID NO:759, SEQ ID
NO:761, SEQ ID NO:763, SEQ ID NO:765, SEQ ID
NO:767, SEQ ID NO:769, SEQ ID NO:771, SEQ ID
NO:773, SEQ ID NO:775, SEQ ID NO:777, SEQ ID
NO:779, SEQ ID NO:781, SEQ ID NO:783, SEQ ID
NO:785, SEQ ID NO:787, SEQ ID NO:789, SEQ ID
NO:791, SEQ ID NO:793, SEQ ID NO:795, SEQ ID
NO:797, SEQ ID NO:799, SEQ ID NO:801, SEQ ID
NO:803, SEQ ID NO:805, SEQ ID NO:807, SEQ ID
NO:809, SEQ ID NO:811, SEQ ID NO:813, SEQ ID
NO:815, SEQ ID NO:817, SEQ ID NO:819, SEQ ID
NO:821, SEQ ID NO:823, SEQ ID NO:825, SEQ ID
NO:827, SEQ ID NO:829, SEQ ID NO:831, SEQ ID
NO:833, SEQ ID NO:835, SEQ ID NO:837, SEQ ID
NO:839, SEQ ID NO:841, SEQ ID NO:843, SEQ ID
NO:845, SEQ ID NO:847, SEQ ID NO:849, SEQ ID
NO:851, SEQ ID NO:853, SEQ ID NO:855, SEQ ID
NO:857, SEQ ID NO:859, SEQ ID NO:861, SEQ ID
NO:863, SEQ ID NO:865, SEQ ID NO:867, SEQ ID
NO:869, SEQ ID NO:871, SEQ ID NO:873, SEQ ID
NO:875, SEQ ID NO:877, SEQ ID NO:879, SEQ ID
NO:881, SEQ ID NO:883, SEQ ID NO:885, SEQ ID
NO:887, SEQ ID NO:889, SEQ ID NO:891, SEQ ID
NO:893, SEQ ID NO:895, SEQ ID NO:897, SEQ ID
NO:899, SEQ ID NO:901, SEQ ID NO:903, SEQ ID
NO:905, SEQ ID NO:907, SEQ ID NO:909, SEQ ID
NO:911, SEQ ID NO:913, SEQ ID NO:915, SEQ ID
NO:917, SEQ ID NO:919, SEQ ID NO:921, SEQ ID
NO:923, SEQ ID NO:925, SEQ ID NO:927, SEQ ID
NO:929, SEQ ID NO:931, SEQ ID NO:933, SEQ ID
NO:935, SEQ ID NO:937, SEQ ID NO:939, SEQ ID
NO:941, SEQ ID NO:943, SEQ ID NO:945, SEQ ID
NO:947, SEQ ID NO:949, SEQ ID NO:951, SEQ ID NO:953, SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, and/or SEQ ID NO:975;

wherein the nucleic acid encodes at least one polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, or encodes a polypeptide or peptide capable of generating a transferase specific antibody, e.g., a transaminase, e.g., a d-amino-acid transferase, and/or an oxidoreductase, e.g., a dehydrogenase, e.g., a d-amino-acid dehydrogenase specific antibody (a polypeptide or peptide that acts as an epitope or immunogen), (b) the nucleic acid (polynucleotide) of (a), wherein the sequence identities are determined: (A) by analysis with a sequence comparison algorithm or by a visual inspection, or (B) over a region of at least about 20, 30, 40, 50, 75, 100, 150, 200, 250, 300, 350, 400, 450, 500, 550, 600, 650, 700, 750, 800, 850, 900, 950, 1000, 1050, 1100, 1150 or more residues, or over the full length of a cDNA, transcript (mRNA) or gene;

(c) the nucleic acid (polynucleotide) of (a) or (b), wherein the sequence comparison algorithm is a BLAST version 2.2.2 algorithm where a filtering setting is set to blastall-p blastp-d "nr pataa"-F F, and all other options are set to default;

(d) a nucleic acid (polynucleotide) encoding at least one polypeptide or peptide, wherein the nucleic acid comprises a sequence that hybridizes under stringent conditions to a nucleic acid comprising the sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521, SEQ ID NO:523, SEQ ID NO:525, SEQ ID NO:527, SEQ ID NO:529, SEQ ID NO:531, SEQ ID NO:533, SEQ ID NO:535, SEQ ID NO:537, SEQ ID NO:539, SEQ ID NO:541, SEQ ID NO:543, SEQ ID NO:545, SEQ ID NO:547, SEQ ID NO:549, SEQ ID NO:551, SEQ ID NO:553, SEQ ID NO:555, SEQ ID NO:557, SEQ ID NO:559, SEQ ID NO:561, SEQ ID NO:563, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:589, SEQ ID NO:591, SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619, SEQ ID NO:621, SEQ ID NO:623, SEQ ID NO:625, SEQ ID NO:627, SEQ ID NO:629, SEQ ID NO:631, SEQ ID NO:633, SEQ ID NO:635, SEQ ID NO:637, SEQ ID NO:639, SEQ ID NO:641, SEQ ID NO:643, SEQ ID NO:645, SEQ ID NO:647, SEQ ID NO:649, SEQ ID NO:651, SEQ ID NO:653, SEQ ID NO:655, SEQ ID NO:657, SEQ ID NO:659, SEQ ID NO:661, SEQ ID NO:663, SEQ ID NO:665, SEQ ID NO:667, SEQ ID NO:669, SEQ ID NO:671, SEQ ID NO:673, SEQ ID NO:675, SEQ ID NO:677, SEQ ID NO:679, SEQ ID NO:681, SEQ ID NO:683, SEQ ID NO:685, SEQ ID NO:687, SEQ ID NO:689, SEQ ID NO:691, SEQ ID NO:693, SEQ ID NO:695, SEQ ID NO:697, SEQ ID NO:699, SEQ ID NO:701, SEQ ID NO:703, SEQ ID NO:705, SEQ ID NO:707, SEQ ID NO:709, SEQ ID NO:711, SEQ ID NO:713, SEQ ID NO:715, SEQ ID NO:717, SEQ ID NO:719, SEQ ID NO:721, SEQ ID NO:723, SEQ ID NO:725, SEQ ID NO:727, SEQ ID NO:729, SEQ ID NO:731, SEQ ID NO:733, SEQ ID NO:735, SEQ ID NO:737, SEQ ID NO:739, SEQ ID NO:741, SEQ ID NO:743, SEQ ID NO:745, SEQ ID NO:747, SEQ ID NO:749, SEQ ID NO:751, SEQ ID NO:753, SEQ ID NO:755, SEQ ID NO:757, SEQ ID NO:759, SEQ ID NO:761, SEQ ID NO:763, SEQ ID NO:765, SEQ ID NO:767, SEQ ID NO:769, SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, SEQ ID NO:791, SEQ ID NO:793, SEQ ID NO:795, SEQ ID NO:797, SEQ ID NO:799, SEQ ID NO:801, SEQ ID NO:803, SEQ ID NO:805, SEQ ID NO:807, SEQ ID NO:809, SEQ ID NO:811, SEQ ID NO:813, SEQ ID NO:815, SEQ ID NO:817, SEQ ID NO:819, SEQ ID NO:821, SEQ ID NO:823, SEQ ID NO:825, SEQ ID NO:827, SEQ ID NO:829, SEQ ID NO:831, SEQ ID NO:833, SEQ ID NO:835, SEQ ID NO:837, SEQ ID NO:839, SEQ ID NO:841, SEQ ID NO:843, SEQ ID NO:845, SEQ ID NO:847, SEQ ID NO:849, SEQ ID NO:851, SEQ ID NO:853, SEQ ID NO:855, SEQ ID NO:857, SEQ ID NO:859, SEQ ID NO:861, SEQ ID NO:863, SEQ ID NO:865, SEQ ID NO:867, SEQ ID NO:869, SEQ ID NO:871, SEQ ID NO:873, SEQ ID NO:875, SEQ ID NO:877, SEQ ID NO:879, SEQ ID NO:881, SEQ ID NO:883, SEQ ID NO:885, SEQ ID NO:887, SEQ ID NO:889, SEQ ID NO:891, SEQ ID NO:893, SEQ ID NO:895, SEQ ID NO:897, SEQ ID NO:899, SEQ ID NO:901, SEQ ID NO:903, SEQ ID NO:905, SEQ ID NO:907, SEQ ID NO:909, SEQ ID NO:911, SEQ ID NO:913, SEQ ID NO:915, SEQ ID NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, SEQ ID NO:941, SEQ ID NO:943, SEQ ID NO:945, SEQ ID NO:947, SEQ ID NO:949, SEQ ID NO:951, SEQ ID NO:953, SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, and/or SEQ ID NO:975, and the stringent conditions comprise a wash step comprising a wash in 0.2×SSC at a temperature of about 65° C. for about 15 minutes;

(e) the nucleic acid (polynucleotide) of any of (a) to (d) having a length of at least about 20, 25, 30, 50, 75, 100, 125, 150, 175, 200, 225, 300, 350, 400, 450, 500, 550, 600, 650, 700, 750, 800, 850, 900, 950, 1000, 1050, 1100, 1150 or more nucleotide residues, or the full length of a gene or a transcript;

(f) a nucleic acid (polynucleotide) encoding at least one polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, wherein the polypeptide comprises the sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976, or enzymatically active fragments thereof;

(g) the nucleic acid (polynucleotide) of any of (a) to (f) and encoding a polypeptide having at least one conservative amino acid substitution and retaining its transferase activity, e.g., transaminase activity, e.g., d-amino-acid transferase activity, and/or oxidoreductase activity, e.g., dehydrogenase activity, e.g., d-amino-acid dehydrogenase activity, wherein the at least one conservative amino acid substitution comprises substituting an amino acid with another amino acid of like characteristics; or, a conservative substitution comprises: replacement of an aliphatic amino acid with another aliphatic amino acid; replacement of a Serine with a Threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;

(h) the nucleic acid (polynucleotide) of any of (a) to (g) encoding a polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity but lacking a signal sequence, a pre-pro domain, a binding domain, and/or other domain;

(i) the nucleic acid (polynucleotide) of (h), wherein the binding domain comprises, or consists of, a NAD, a NAD(P), a calcium, a thiamine, a FAD, a zinc, a DNA and/or a lipoyl binding domain;

(j) the nucleic acid (polynucleotide) of any of (a) to (i) encoding a polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity further comprising a heterologous sequence;

(k) the nucleic acid (polynucleotide) of (j), wherein the heterologous sequence comprises, or consists of a sequence encoding: (A) a heterologous signal sequence, a heterologous domain, a heterologous binding domain, a heterologous dockerin domain, a heterologous catalytic domain (CD), or a combination thereof; (B) the sequence of (l), wherein the heterologous signal sequence, binding domain or catalytic domain (CD) is derived from a heterologous enzyme; or, (C) a tag, an epitope, a targeting peptide, a cleavable sequence, a detectable moiety or an enzyme;

(l) the nucleic acid (polynucleotide) of (k), wherein the heterologous binding domain comprises, or consists of, a NAD, a NAD(P), a calcium, a thiamine, a FAD, a zinc, a DNA and/or a lipoyl binding domain;

(m) the nucleic acid (polynucleotide) of (l), wherein the heterologous signal sequence targets the encoded protein to a vacuole, the endoplasmic reticulum, a chloroplast or a starch granule; or (n) a nucleic acid sequence (polynucleotide) fully (completely) complementary to the sequence of any of (a) to (m).

The invention provides isolated, synthetic or recombinant nucleic acids comprising a nucleic acid encoding at least one polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, wherein the polypeptide has a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976, or enzymatically active fragments thereof, including the sequences described herein and in Tables 1, 2 and 3, and the Sequence Listing (all of these sequences are "exemplary enzymes/polypeptides of the invention"), and enzymatically active subsequences (fragments) thereof and/or immunologically active subsequences thereof (such as epitopes or immunogens) (all "peptides of the invention") and variants thereof (all of these sequences encompassing polypeptide and peptide sequences of the invention) (or, hereinafter referred to as the exemplary polypeptide sequences of the inventions).

The invention provides isolated, synthetic or recombinant nucleic acids comprising sequences completely complementary to all of these nucleic acid sequences of the invention (complementary (non-coding) and coding sequences also hereinafter collectively referred to as nucleic acid sequences of the invention).

In one aspect, the sequence identity is at least about 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% (complete) sequence identity (homology). In one aspect, the sequence identity is over a region of at least about 150, 175, 200, 225, 250, 275, 300, 350, 400, 450, 500, 550, 600, 650, 700, 750, 800, 850, 900, 950, 1000, 1050, 1100, 1150 or more residues, or the full length of a gene or a transcript. For example, the invention provides isolated, synthetic or recombinant nucleic acids comprising a nucleic acid sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521, SEQ ID NO:523, SEQ ID NO:525, SEQ ID NO:527, SEQ ID NO:529, SEQ ID NO:531, SEQ ID NO:533, SEQ ID NO:535, SEQ ID NO:537, SEQ ID NO:539, SEQ ID NO:541, SEQ ID NO:543, SEQ ID NO:545, SEQ ID NO:547, SEQ ID NO:549, SEQ ID NO:551, SEQ ID NO:553, SEQ ID NO:555, SEQ ID NO:557, SEQ ID NO:559, SEQ ID NO:561, SEQ ID NO:563, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:589, SEQ ID NO:591, SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619, SEQ ID NO:621, SEQ ID NO:623, SEQ ID NO:625, SEQ ID NO:627, SEQ ID NO:629, SEQ ID NO:631, SEQ ID NO:633, SEQ ID NO:635, SEQ ID NO:637, SEQ ID NO:639, SEQ ID NO:641, SEQ ID NO:643, SEQ ID NO:645, SEQ ID NO:647, SEQ ID NO:649, SEQ ID NO:651, SEQ ID NO:653, SEQ ID NO:655, SEQ ID NO:657, SEQ ID NO:659, SEQ ID NO:661, SEQ ID NO:663, SEQ ID NO:665, SEQ ID NO:667, SEQ ID NO:669, SEQ ID NO:671, SEQ ID NO:673, SEQ ID NO:675, SEQ ID NO:677, SEQ ID NO:679, SEQ ID NO:681, SEQ ID NO:683, SEQ ID NO:685, SEQ ID NO:687, SEQ ID NO:689, SEQ ID NO:691, SEQ ID NO:693, SEQ ID NO:695, SEQ ID NO:697, SEQ ID NO:699, SEQ ID NO:701, SEQ ID NO:703, SEQ ID NO:705, SEQ ID NO:707, SEQ ID NO:709, SEQ ID NO:711, SEQ ID NO:713, SEQ ID NO:715, SEQ ID NO:717, SEQ ID NO:719, SEQ ID NO:721, SEQ ID NO:723, SEQ ID NO:725, SEQ ID NO:727, SEQ ID NO:729, SEQ ID NO:731, SEQ ID NO:733, SEQ ID NO:735, SEQ ID NO:737, SEQ ID NO:739, SEQ ID NO:741, SEQ ID NO:743, SEQ ID NO:745, SEQ ID NO:747, SEQ ID NO:749, SEQ ID NO:751, SEQ ID NO:753, SEQ ID NO:755, SEQ ID NO:757, SEQ ID NO:759, SEQ ID NO:761, SEQ ID NO:763, SEQ ID NO:765, SEQ ID NO:767, SEQ ID NO:769, SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, SEQ ID NO:791, SEQ ID NO:793, SEQ ID NO:795, SEQ ID NO:797, SEQ ID NO:799, SEQ ID NO:801, SEQ ID NO:803, SEQ ID NO:805, SEQ ID NO:807, SEQ ID NO:809, SEQ ID NO:811, SEQ ID NO:813, SEQ ID NO:815, SEQ ID NO:817, SEQ ID NO:819, SEQ ID NO:821, SEQ ID NO:823, SEQ ID NO:825, SEQ ID NO:827, SEQ ID NO:829, SEQ ID NO:831, SEQ ID NO:833, SEQ ID NO:835, SEQ ID NO:837, SEQ ID NO:839, SEQ ID NO:841, SEQ ID NO:843, SEQ ID NO:845, SEQ ID NO:847, SEQ ID NO:849, SEQ ID NO:851, SEQ ID NO:853, SEQ ID NO:855, SEQ ID NO:857, SEQ ID NO:859, SEQ ID NO:861, SEQ ID NO:863, SEQ ID NO:865, SEQ ID NO:867, SEQ ID NO:869, SEQ ID NO:871, SEQ ID NO:873, SEQ ID NO:875, SEQ ID NO:877, SEQ ID NO:879, SEQ ID NO:881, SEQ ID NO:883, SEQ ID NO:885, SEQ ID NO:887, SEQ ID NO:889, SEQ ID NO:891, SEQ ID NO:893, SEQ ID NO:895, SEQ ID NO:897, SEQ ID NO:899, SEQ ID NO:901, SEQ ID NO:903, SEQ ID NO:905, SEQ ID NO:907, SEQ ID NO:909, SEQ ID NO:911, SEQ ID NO:913, SEQ ID NO:915, SEQ ID NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, SEQ ID NO:941, SEQ ID NO:943, SEQ ID NO:945, SEQ ID NO:947, SEQ ID NO:949, SEQ ID NO:951, SEQ ID NO:953, SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, and/or SEQ ID NO:975, e.g., as described in Tables 1, 2 and 3 and in the Sequence Listing (all of these sequences are "exemplary polynucleotides of the invention"), and enzymatically active subsequences (fragments) thereof.

The invention provides isolated, synthetic or recombinant nucleic acids encoding a polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, wherein the nucleic acid has at least one sequence modification of an exemplary sequence of the invention, or, any sequence of the invention.

In one aspect (optionally), the isolated, synthetic or recombinant nucleic acids of the invention have a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, e.g., wherein the activity comprises catalyzing the transfer of a chemical group, catalyzing transamination, catalyzing the reaction: D-alanine+2-oxoglutarate pyruvate+D-glutamate, and/or catalyzing an oxidation-reduction reaction, catalyzing the removal of hydrogen atoms, and/or catalyzing the reaction: D-amino acid+$H_2O$+acceptor<=>a 2-oxo acid+$NH_3$+reduced acceptor.

In one aspect, the transferase activity, e.g., transaminase activity, e.g., d-amino-acid transferase activity, and/or oxidoreductase activity, e.g., dehydrogenase activity, e.g., d-amino-acid dehydrogenase activity is thermostable, e.g., wherein the polypeptide retains a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity under conditions comprising a temperature range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. In some embodiments, the thermostable polypeptides according to the invention retains activity, e.g., a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, at a temperature in the ranges described above, at about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 9.0, about pH 9.5, about pH 10.0, about pH 10.5, about pH 11.0, about pH 11.5, about pH 12.0 or more.

In one aspect, the transferase activity, e.g., transaminase activity, e.g., d-amino-acid transferase activity, and/or oxidoreductase activity, e.g., dehydrogenase activity, e.g., d-amino-acid dehydrogenase activity is thermotolerant, e.g., wherein the polypeptide retains a transferase activity, e.g., a transaminase activity, e.g., a d-amino-acid transferase activity, or a ω-transaminase activity and/or an oxidoreductase activity, e.g., a dehydrogenase activity, e.g., a d-amino-acid dehydrogenase activity after exposure to a temperature in the range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. The thermotolerant polypeptides according to the invention can retain activity, e.g. a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, after exposure to a temperature in the range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. In some embodiments, the thermotolerant polypeptides according to the invention retains activity, e.g. a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, after exposure to a temperature in the ranges described above, at about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 9.0, about pH 9.5, about pH 10.0, about pH 10.5, about pH 11.0, about pH 11.5, about pH 12.0 or more.

In one aspect, the transferase activity, e.g., transaminase activity, e.g., d-amino-acid transferase activity, and/or oxidoreductase activity, e.g., dehydrogenase activity, e.g., d-amino-acid dehydrogenase activity of polypeptides encoded by nucleic acids of the invention retain activity under acidic conditions comprising about pH 6.5, pH 6, pH 5.5, pH 5, pH 4.5, pH 4.0, pH 3.5, pH 3.0 or less (more acidic) pH, or, retain a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity after exposure to acidic conditions comprising about pH 6.5, pH 6, pH 5.5, pH 5, pH 4.5, pH 4.0, pH 3.5, pH 3.0 or less (more acidic) pH; or, retain activity under basic conditions comprising about pH 7, pH 7.5 pH 8.0, pH 8.5, pH 9, pH 9.5, pH 10, pH 10.5, pH 11, pH 11.5, pH 12, pH 12.5 or more (more basic) or, retain a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity after exposure to basic conditions comprising about pH 7, pH 7.5 pH 8.0, pH 8.5, pH 9, pH 9.5, pH 10, pH 10.5, pH 11, pH 11.5, pH 12, pH 12.5 or more (more basic). In one aspect, transferase activity, e.g., transaminase activity, e.g., d-amino-acid transferase activity, and/or oxidoreductase activity, e.g., dehydrogenase activity, e.g., d-amino-acid dehydrogenase activity of polypeptides encoded by nucleic acids of the invention retain activity at a temperature of at least about 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 7.5 pH 8.0, pH 8.5, pH 9, pH 9.5, pH 10, pH 10.5, pH 11, pH 11.5, pH 12, pH 12.5 or more (more basic).

The invention provides expression cassettes, cloning vehicles, or a vector (e.g., expression vectors) comprising a nucleic acid comprising a sequence of the invention. The cloning vehicle can comprise a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise an artificial chromosome comprising a bacterial artificial chromosome (BAC), a bacteriophage P1-derived vector (PAC), a yeast artificial chromosome (YAC), or a mammalian artificial chromosome (MAC).

The invention provides nucleic acid probes for identifying a nucleic acid encoding a polypeptide with a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, wherein the probe comprises at least about 10, 15, 20, 25, 30, 35, 40, 45, 50, 55, 60, 65, 70, 75, 100, 125, 150, 175, 200, 225, 250, 275, 300 or more consecutive bases of a nucleic acid comprising an exemplary sequence of the invention, or, any sequence of the invention (as defined herein), wherein in one aspect (optionally) the probe comprises an oligonucleotide comprising between at least about 10 to 300, about 25 to 250, about 10 to 50, about 20 to 60, about 30 to 70, about 40 to 80, about 60 to 100, or about 50 to 150 or more consecutive bases.

The invention provides amplification primer pairs for amplifying a nucleic acid encoding a polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, wherein the primer pair is capable of amplifying a nucleic acid comprising an exemplary sequence of the invention, or, any sequence of the invention (as defined herein), or a subsequence thereof, wherein optionally a member of the amplification primer sequence pair comprises an oligonucleotide comprising at least about 10 to 50 consecutive bases of the sequence, or, about 10, 11, 12, 13, 14, 15, 16, 17, 18, 19, 20, 21, 22, 23, 24, 25, 26, 27, 28, 29, 30, 31, 32, 33, 34, 35 or more consecutive bases of the sequence. The invention provides amplification primer pairs wherein the primer pair comprises a first member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of an exemplary sequence of the invention, or, any sequence of the invention (as defined herein), and a second member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of the complementary strand of the first member.

The invention provides a transferase-, e.g., a transaminase-, e.g., a d-amino-acid transferase-, and/or an oxidoreductase-, e.g., a dehydrogenase-, e.g., a d-amino-acid dehydrogenase-encoding nucleic acids generated by amplification of a polynucleotide using an amplification primer pair of the invention, wherein optionally the amplification is by polymerase chain reaction (PCR). In one aspect, the nucleic acid is generated by amplification of a gene library, wherein in one aspect (optionally) the gene library is an environmental library. The invention provides isolated, synthetic or recombinant transferases and/or oxidoreductases encoded by a transferase-, e.g., a transaminase-, e.g., a d-amino-acid transferase-, and/or an oxidoreductase-, e.g., a dehydrogenase-, e.g., a d-amino-acid dehydrogenase-encoding nucleic acid generated by amplification of a polynucleotide using an amplification primer pair of the invention. The invention provides methods of amplifying a nucleic acid encoding a polypeptide having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, the methods comprising the step of amplification of a template nucleic acid with an amplification primer sequence pair capable of amplifying an exemplary sequence of the invention, or, any sequence of the invention (as defined herein), or a subsequence thereof.

The invention provides expression cassette, a vector or a cloning vehicle comprising a nucleic acid comprising a sequence of the invention, wherein optionally the cloning vehicle comprises a viral vector, a plasmid, a phage, a phagemid, a cosmid, a fosmid, a bacteriophage or an artificial chromosome. The viral vector can comprise an adenovirus vector, a retroviral vector or an adeno-associated viral vector, or, the artificial chromosome comprises a bacterial artificial chromosome (BAC), a bacteriophage P1-derived vector (PAC), a yeast artificial chromosome (YAC), or a mammalian artificial chromosome (MAC).

The invention provides transformed cells comprising a nucleic acid or vector of the invention, or an expression cassette or cloning vehicle of the invention. The transformed cell can be a bacterial cell, a mammalian cell, a fungal cell, a yeast cell, an insect cell or a plant cell.

The invention provides transgenic non-human animals comprising a sequence of the invention. The transgenic non-human animal can be a mouse, a rat, a rabbit, a sheep, a pig, a chicken, a goat, a fish, a dog, or a cow. The invention provides transgenic plants comprising a sequence of the invention, e.g., wherein the plant is a corn plant, a sorghum plant, a potato plant, a tomato plant, a wheat plant, an oilseed plant, a rapeseed plant, a soybean plant, a rice plant, a barley plant, a grass, or a tobacco plant. The invention provides transgenic seeds comprising a sequence of the invention, e.g., wherein the seed is a corn seed, a wheat kernel, an oilseed, a rapeseed, a soybean seed, a palm kernel, a sunflower seed, a sesame seed, a rice, a barley, a peanut or a tobacco plant seed.

The invention provides antisense oligonucleotides comprising a nucleic acid sequence complementary to or capable of hybridizing under stringent conditions to a sequence of the invention (including, e.g., exemplary sequences of the invention), or a subsequence thereof, wherein optionally the antisense oligonucleotide is between about 10 to 50, about 20 to 60, about 30 to 70, about 40 to 80, or about 60 to 100 bases in length, and in one aspect (optionally) the stringent conditions comprise a wash step comprising a wash in 0.2×SSC at a temperature of about 65° C. for about 15 minutes.

The invention provides methods of inhibiting the translation of a transferase, e.g., a transaminase, e.g., a d-amino-acid transferase, and/or an oxidoreductase, e.g., a dehydrogenase, e.g., a d-amino-acid dehydrogenase message in a cell comprising administering to the cell or expressing in the cell an antisense oligonucleotide comprising a nucleic acid sequence complementary to or capable of hybridizing under stringent conditions to a sequence of the invention (including, e.g., exemplary sequences of the invention).

The invention provides double-stranded inhibitory RNA (RNAi) molecules comprising a subsequence of a sequence of the invention (including, e.g., exemplary sequences of the invention). The double-stranded inhibitory RNA (RNAi) molecule can be about 10, 11, 12, 13, 14, 15, 16, 17, 18, 19, 20, 21, 22, 23, 24, 25, 26, 27, 28, 29, or 30 or more duplex nucleotides in length. The invention provides methods of inhibiting the expression of a transferase, e.g., a transaminase, e.g., a d-amino-acid transferase, and/or an oxidoreductase, e.g., a dehydrogenase, e.g., a d-amino-acid dehydrogenase in a cell comprising administering to the cell or expressing in the cell a double-stranded inhibitory RNA (iRNA), wherein the RNA comprises a subsequence of a sequence of the invention (including, e.g., exemplary sequences of the invention).

The invention provides isolated, synthetic or recombinant polypeptides having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, or polypeptides capable of generating an immune response specific for a transferase, e.g., a transaminase, e.g., a d-amino-acid transferase, and/or an oxidoreductase, e.g., a dehydrogenase, e.g., a d-amino-acid dehydrogenase (e.g., an epitope); and in alternative aspects peptide and polypeptide of the invention comprise a sequence:

(a) comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or has 100% (complete) sequence identity to SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976, or enzymatically active fragments thereof, wherein the polypeptide or peptide of (i) or (ii) has a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, or the polypeptide or peptide is capable of generating a transferase specific antibody, e.g., a transaminase, e.g., a d-amino-acid transferase, and/or an oxidoreductase, e.g., a dehydrogenase, e.g., a d-amino-acid dehydrogenase specific antibody (a polypeptide or peptide that acts as an epitope or immunogen), (b) the polypeptide or peptide of (a), wherein the sequence identities are determined: (A) by analysis with a sequence comparison algorithm or by a visual inspection, or (B) over a region of at least about 20, 25, 30, 35, 40, 45, 50, 55, 60, 75, 100, 150, 200, 250, 300 or more amino acid residues, or over the full length of the polypeptide or peptide or enzyme, and/or enzymatically active subsequences (fragments) thereof, (c) the polypeptide or peptide of (a) of (b), wherein the sequence identities are determined by analysis with a sequence comparison algorithm or by a visual inspection, and optionally the sequence comparison algorithm is a BLAST version 2.2.2 algorithm where a filtering setting is set to blastall-p blastp-d "nr pataa"-F F, and all other options are set to default;

(d) an amino acid sequence encoded by the nucleic acid of claim 1, wherein the polypeptide has (i) a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity, or, (ii) has immunogenic activity in that it is capable of generating an antibody that specifically binds to a polypeptide having a sequence of (a), and/or enzymatically active subsequences (fragments) thereof;

(e) the amino acid sequence of any of (a) to (d), and comprising at least one amino acid residue conservative substitution, and the polypeptide or peptide retains transferase activity, e.g., transaminase activity, e.g., d-amino-acid transferase activity, and/or oxidoreductase activity, e.g., dehydrogenase activity, e.g., d-amino-acid dehydrogenase activity;

(e) the amino acid sequence of (d), wherein the conservative substitution comprises replacement of an aliphatic amino acid with another aliphatic amino acid; replacement of a serine with a threonine or vice versa; replacement of an acidic residue with another acidic residue; replacement of a residue bearing an amide group with another residue bearing an amide group; exchange of a basic residue with another basic residue; or, replacement of an aromatic residue with another aromatic residue, or a combination thereof, (f) the amino acid sequence of (e), wherein the aliphatic residue comprises Alanine, Valine, Leucine, Isoleucine or a synthetic equivalent thereof; the acidic residue comprises Aspartic acid, Glutamic acid or a synthetic equivalent thereof; the residue comprising an amide group comprises Aspartic acid, Glutamic acid or a synthetic equivalent thereof; the basic residue comprises Lysine, Arginine or a synthetic equivalent thereof; or, the aromatic residue comprises Phenylalanine, Tyrosine or a synthetic equivalent thereof;

(g) the polypeptide of any of (a) to (f) having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity but lacking a signal sequence, a prepro domain, a binding domain, and/or other domain, (h) the polypeptide of (g) wherein the binding domain comprises, or consists of, a NAD, a NAD(P), a calcium, a thiamine, a FAD, a zinc, a DNA and/or a lipoyl binding domain;

(i) the polypeptide of any of (a) to (h) having a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity further comprising a heterologous sequence;

(j) the polypeptide of (i), wherein the heterologous sequence comprises, or consists of: (A) a heterologous signal sequence, a heterologous domain, a heterologous binding domain, a heterologous dockerin domain, a heterologous catalytic domain (CD), or a combination thereof; (B) the sequence of (A), wherein the heterologous signal sequence, binding domain or catalytic domain (CD) is derived from a heterologous enzyme; and/or, (C) a tag, an epitope, a targeting peptide, a cleavable sequence, a detectable moiety or an enzyme;

(k) the polypeptide of (i) or (j), wherein the heterologous sequence or the heterologous binding domain comprises, or consists of, a NAD, a NAD(P), a calcium, a thiamine, a FAD, a zinc, a DNA and/or a lipoyl binding domain;

(l) polypeptide of (i), wherein the heterologous signal sequence targets the encoded protein to a vacuole, the endoplasmic reticulum, a chloroplast or a starch granule; or (m) comprising an amino acid sequence encoded any nucleic acid sequence of this invention.

In one aspect, the transferase activity, e.g., transaminase activity, e.g., d-amino-acid transferase activity, and/or oxidoreductase activity, e.g., dehydrogenase activity, e.g., d-amino-acid dehydrogenase activity comprises catalyzing the transfer of a chemical group, catalyzing transamination, catalyzing the reaction: D-alanine+2-oxoglutarate<=>pyruvate+D-glutamate, and/or catalyzing an oxidation-reduction reaction, catalyzing the removal of hydrogen atoms, and/or catalyzing the reaction: D-amino acid+$H_2O$+acceptor<=>a 2-oxo acid+$NH_3$+reduced acceptor.

The invention provides isolated, synthetic or recombinant polypeptides comprising a polypeptide of the invention and lacking a signal sequence or a prepro sequence. The invention provides isolated, synthetic or recombinant polypeptides comprising a polypeptide of the invention and having a heterologous signal sequence or a heterologous prepro sequence.

In one aspect, a polypeptide of the invention has transferase activity, e.g., transaminase activity, e.g., d-amino-acid transferase activity, and/or oxidoreductase activity, e.g., dehydrogenase activity, e.g., d-amino-acid dehydrogenase activity comprising a specific activity at about 37° C. in the range from about 100 to about 1000 units per milligram of protein, from about 500 to about 750 units per milligram of protein, from about 500 to about 1200 units per milligram of protein, or from about 750 to about 1000 units per milligram of protein. In alternative aspects, polypeptides of the invention have transferase activity, e.g., transaminase activity, e.g., d-amino-acid transferase activity, and/or oxidoreductase activity, e.g., dehydrogenase activity, e.g., d-amino-acid dehydrogenase activity in the range of between about 0.05 to 20 units per gram, or 0.05, 0.10, 0.20, 0.30, 0.40, 0.50, 0.60, 0.70, 0.80, 0.90, 1.0, 1.5, 2.0, 2.5, 3.0, 3.5, 4.0, 4.5, 5.0, 5.5, 6.0, 6.5, 7, 8, 9, 10, 11, 12, 13, 14, 15, 16, 17, 18, 19 or 20 or more units per gram, where a unit equals one µmol of product released per minute per mg of enzyme. In one embodiment, for transaminases, one unit of activity equals one umol of alpha-keto acid or ketone produced per minute per mg of enzyme (formed from the respective alpha-amino acid or amine). In an alternative embodiment, for transaminases, one unit of activity equals one umol of alpha-amino acid or amine produced per minute per mg of enzyme (formed from the respective alpha-keto acid or ketone).

In one aspect, the polypeptides of the invention comprise at least one glycosylation site or further comprises a polysaccharide. The glycosylation can be an N-linked glycosylation, e.g., wherein the polypeptide is glycosylated after being expressed in a *P. pastoris* or a *S. pombe*.

The invention provides protein preparation comprising a polypeptide of the invention, wherein the protein preparation comprises a liquid, a slurry, a solid or a gel. The invention provides heterodimers comprising a polypeptide of the invention and a second domain. The second domain can be a polypeptide and the heterodimer is a fusion protein. The second domain can be an epitope or a tag.

The invention provides homodimers or heterodimers comprising a polypeptide of the invention. The invention provides immobilized polypeptides, wherein the polypeptide comprises a sequence of the invention, or a subsequence thereof, or a polypeptide encoded by a nucleic acid of the invention, or a polypeptide comprising a polypeptide of the invention and a second domain, e.g., wherein the polypeptide is immobilized on or inside a cell, a vesicle, a liposome, a film, a membrane, a metal, a resin, a polymer, a ceramic, a glass, a microelectrode, a graphitic particle, a bead, a gel, a plate, an array, a capillary tube, a crystal, a tablet, a pill, a capsule, a powder, an agglomerate, a surface, a porous structure, or materials such as wood chips, brownstock, pulp, paper, and materials deriving therefrom.

The transferases and/or oxidoreductases of the invention can be used or formulated alone or as mixture (a "cocktail") of transferases and/or oxidoreductases, and other hydrolytic enzymes such as cellulases, mannanases, proteases, lipases, amylases, or redox enzymes such as laccases, peroxidases, catalases, oxidases, or reductases. They can be used formulated in a solid form such as a powder, a lyophilized preparation, a granule, a tablet, a bar, a crystal, a capsule, a pill, a pellet, or in a liquid form such as in an aqueous solution, an aerosol, a gel, a paste, a slurry, an aqueous/oil emulsion, a cream, a capsule, or in a vesicular or micellar suspension. The formulations of the invention can comprise any or a combination of the following ingredients: polyols such as a polyethylene glycol, a polyvinylalcohol, a glycerol, a sugar such as a sucrose, a sorbitol, a trehalose, a glucose, a fructose, a maltose, a mannose, a gelling agent such as a guar gum, a carageenan, an alginate, a dextrans, a cellulosic derivative, a pectin, a salt such as a sodium chloride, a sodium sulfate, an ammonium sulfate, a calcium chloride, a magnesium chloride, a zinc chloride, a zinc sulfate, a salt of a fatty acid and a fatty acid derivative, a metal chelator such as an EDTA, an EGTA, a sodium citrate, an antimicrobial agent such as a fatty acid or a fatty acid derivative, a paraben, a sorbate, a benzoate, an additional modulating compound to block the impact of an enzyme such as a protease, a bulk proteins such as a BSA, a wheat hydrolysate, a borate compound, an amino acid or a peptide, an appropriate pH or temperature modulating compound, an emulsifier such as a non-ionic and/or an ionic detergent, a redox agent such as a cystine/cysteine, a glutathione, an oxidized glutathione, a reduced or an antioxidant compound such as an ascorbic acid, or a dispersant. Cross-linking and protein modification such as pegylation, fatty acid modification, glycosylation can also be used to improve enzyme stability.

The invention provides arrays comprising immobilized polypeptide(s) and/or nucleic acids of the invention, and arrays comprising an immobilized oligonucleotide of the invention. The enzymes, fragments thereof and nucleic acids which encode the enzymes, or probes of the invention, and fragments thereof, can be affixed to a solid support; and these embodiments can be economical and efficient in the use of enzymes and nucleic acids of the invention in industrial, medical, research, pharmaceutical, food and feed and food and feed supplement processing and other applications and processes. For example, a consortium or cocktail of enzymes (or active fragments thereof), which are used in a specific chemical reaction, can be attached to a solid support and dunked into a process vat. The enzymatic reaction can occur. Then, the solid support can be taken out of the vat, along with the enzymes affixed thereto, for repeated use. In one embodiment of the invention, the isolated, synthetic or recombinant nucleic acid is affixed to a solid support. In another embodiment of the invention, the solid support is selected from the group of a gel, a resin, a polymer, a ceramic, a glass, a microelectrode and any combination thereof.

For example, solid supports useful in this invention include gels. Some examples of gels include sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate) hydrogel, BSA-PEG hydrogel, phosphorylated polyvinyl alcohol (PVA), monoaminoethyl-N-aminoethyl (MANA), amino, or any combination thereof. Another solid support useful in the present invention are resins or polymers. Some examples of resins or polymers include cellulose, acrylamide, nylon, rayon, polyester, anion-exchange resin, AMBERLITE™ XAD-7, AMBERLITE™ XAD-8, AMBERLITE™ IRA-94, AMBERLITE™ IRC-50, polyvinyl, polyacrylic, polymethacrylate, or any combination thereof. Another type of solid support useful in the present invention is ceramic. Some examples include non-porous ceramic, porous ceramic, $SiO_2$, $Al_2O_3$. Another type of solid support useful in the present invention is glass. Some examples include non-porous glass, porous glass, aminopropyl glass or any combination thereof. Another type of solid support which can be used is a microelectrode. An example is a polyethyleneimine-coated magnetite. Graphitic particles can be used as a solid support. Another example of a solid support is a cell, such as a red blood cell.

There are many methods which would be known to one of skill in the art for immobilizing enzymes or fragments thereof, or nucleic acids, onto a solid support. Some examples of such methods include electrostatic droplet generation, electrochemical means, via adsorption, via covalent binding, via cross-linking, viA chemical reaction or process, via encapsulation, via entrapment, via calcium alginate, or via poly (2-hydroxyethyl methacrylate). Like methods are described in *Methods in Enzymology, Immobilized Enzymes and Cells*, Part C. 1987. Academic Press. Edited by S. P. Colowick and N. O. Kaplan. Volume 136; and *Immobilization of Enzymes and Cells*. 1997. Humana Press. Edited by G. F. Bickerstaff. Series: Methods in Biotechnology, Edited by J. M. Walker.

The invention provides isolated, synthetic or recombinant antibodies that specifically binds to a polypeptide of the invention. The antibody can be a monoclonal or a polyclonal antibody, or is a single chained antibody. The invention provides hybridomas comprising an antibody that specifically binds to a polypeptide of the invention.

The invention provides methods of isolating or identifying a polypeptide with a transferase activity, e.g., a transaminase activity, e.g., a d-amino-acid transferase activity or a ω-transaminase activity, and/or an oxidoreductase activity, e.g., a dehydrogenase activity, e.g., a d-amino-acid dehydrogenase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity. The invention provides methods of making an anti-transferase, e.g., anti-transaminase, e.g., anti-d-amino-acid transferase, and/or anti-oxidoreductase, e.g., anti-dehydrogenase, e.g., anti-d-amino-acid dehydrogenase antibody comprising administering to a non-human animal a nucleic acid of the invention or a subsequence thereof in an amount sufficient to generate a humoral immune response, thereby making an anti-transferase, e.g., anti-transaminase, e.g., anti-d-amino-acid transferase, and/or anti-oxidoreductase, e.g., anti-dehydrogenase, e.g., anti-d-amino-acid dehydrogenase antibody. The invention provides methods of making an anti-transferase, e.g., anti-transaminase, e.g., anti-d-amino-acid transferase, and/or anti-oxidoreductase, e.g., anti-dehydrogenase, e.g., anti-d-amino-acid dehydrogenase antibody comprising administering to a non-human animal a polypeptide of the invention or a subsequence thereof in an amount sufficient to generate a humoral immune response, thereby making an anti-transferase, e.g., anti-transaminase, e.g., anti-d-amino-acid transferase, and/or anti-oxidoreductase, e.g., anti-dehydrogenase, e.g., anti-d-amino-acid dehydrogenase antibody.

The invention provides methods of producing a recombinant polypeptide comprising the steps of: (a) providing a nucleic acid operably linked to a promoter, wherein the nucleic acid comprises a sequence of the invention; and (b) expressing the nucleic acid of step (a) under conditions that allow expression of the polypeptide, thereby producing a recombinant polypeptide. The method can further comprise transforming a host cell with the nucleic acid of step (a) followed by expressing the nucleic acid of step (a), thereby producing a recombinant polypeptide in a transformed cell.

The invention provides methods for identifying a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity comprising: (a) providing a polypeptide of the invention; (b) providing a transferase, e.g., a transaminase, e.g., a d-amino-acid transferase, and/or an oxidoreductase, e.g., a dehydrogenase, e.g., a d-amino-acid dehydrogenase substrate; and (c) contacting the polypeptide with the substrate of step (b) and detecting a decrease in the amount of substrate or an increase in the amount of a reaction product, wherein a decrease in the amount of the substrate or an increase in the amount of the reaction product detects a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity.

The invention provides methods for identifying a transferase, e.g., a transaminase, e.g., a d-amino-acid transferase, and/or an oxidoreductase, e.g., a dehydrogenase, e.g., a d-amino-acid dehydrogenase substrate comprising: (a) providing a polypeptide of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a transferase, e.g., a transaminase, e.g., a d-amino-acid transferase, and/or an oxidoreductase, e.g., a dehydrogenase, e.g., a d-amino-acid dehydrogenase substrate.

The invention provides methods of determining whether a test compound specifically binds to a polypeptide comprising: (a) expressing a nucleic acid or a vector comprising the nucleic acid under conditions permissive for translation of the nucleic acid to a polypeptide, wherein the nucleic acid has a sequence of the invention; (b) providing a test compound; (c) contacting the polypeptide with the test compound; and (d) determining whether the test compound of step (b) specifically binds to the polypeptide.

The invention provides methods of determining whether a test compound specifically binds to a polypeptide comprising: (a) providing a polypeptide of the invention; (b) providing a test compound; (c) contacting the polypeptide with the test compound; and (d) determining whether the test compound of step (b) specifically binds to the polypeptide.

The invention provides methods for identifying a modulator of a transferase activity, e.g., a transaminase activity, e.g., a d-amino-acid transferase activity, and/or an oxidoreductase activity, e.g., a dehydrogenase activity, e.g., a d-amino-acid dehydrogenase activity comprising: (a) providing a polypeptide of the invention; (b) providing a test compound; (c) contacting the polypeptide of step (a) with the test compound of step (b) and measuring an activity of the transferase, e.g., transaminase, e.g., d-amino-acid transferase, and/or oxidoreductase, e.g., dehydrogenase, e.g., d-amino-acid dehydrogenase, wherein a change in the transferase activity, e.g., transaminase activity, e.g., d-amino-acid transferase activity, and/or oxidoreductase activity, e.g., dehydrogenase activity, e.g., d-amino-acid dehydrogenase activity measured in the presence of the test compound compared to the activity in the absence of the test compound provides a determination that the test compound modulates the transferase activity, e.g., transaminase activity, e.g., d-amino-acid transferase activity, and/or oxidoreductase activity, e.g., dehydrogenase activity, e.g., d-amino-acid dehydrogenase activity. The transferase activity, e.g., transaminase activity, e.g., d-amino-acid transferase activity, and/or oxidoreductase activity, e.g., dehydrogenase activity, e.g., d-amino-acid dehydrogenase activity can be measured by providing a transferase, e.g., a transaminase, e.g., a d-amino-acid transferase, and/or an oxidoreductase, e.g., a dehydrogenase, e.g., a d-amino-acid dehydrogenase substrate and detecting a decrease in the amount of the substrate or an increase in the amount of a reaction product, or, an increase in the amount of the substrate or a decrease in the amount of a reaction product. In one aspect, a decrease in the amount of the substrate or an increase in the amount of the reaction product with the test compound as compared to the amount of substrate or reaction product without the test compound identifies the test compound as an activator of a transferase activity, e.g., a transaminase activity, e.g., a d-amino-acid transferase activity, and/or an oxidoreductase activity, e.g., a dehydrogenase activity, e.g., a d-amino-acid dehydrogenase activity. In one aspect, an increase in the amount of the substrate or a decrease in the amount of the reaction product with the test compound as compared to the amount of substrate or reaction product without the test compound identifies the test compound as an inhibitor of a transferase activity, e.g., a transaminase activity, e.g., a d-amino-acid transferase activity, and/or an oxidoreductase activity, e.g., a dehydrogenase activity, e.g., a d-amino-acid dehydrogenase activity.

The invention provides computer systems comprising a processor and a data storage device wherein said data storage device has stored thereon a polypeptide sequence or a nucleic acid sequence, wherein the polypeptide sequence comprises sequence of the invention, a polypeptide encoded by a nucleic acid of the invention. The computer systems can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity from an environmental sample comprising the steps of: (a) providing an amplification primer sequence pair for amplifying a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity from an environmental sample. One or each member of the amplification primer sequence pair can comprise an oligonucleotide comprising at least about 10 to 50 consecutive bases of a sequence of the invention. In one aspect, the amplification primer sequence pair is an amplification pair of the invention.

The invention provides methods for isolating or recovering a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated, synthetic or recombinant nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant transferase, e.g., transaminase, e.g., d-amino-acid transferase, and/or oxidoreductase, e.g., dehydrogenase, e.g., d-amino-acid dehydrogenase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), Gene Site Saturation Mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a transferase, e.g., a transaminase, e.g., a d-amino-acid transferase, and/or an oxidoreductase, e.g., a dehydrogenase, e.g., a d-amino-acid dehydrogenase having an altered or different activity or an altered or different stability from that of a polypeptide encoded by the template nucleic acid is produced. In one aspect, the variant transferase, e.g., transaminase, e.g., d-amino-acid transferase, and/or oxidoreductase, e.g., dehydrogenase, e.g., d-amino-acid dehydrogenase polypeptide is thermotolerant, and retains some activity after being exposed to an elevated temperature. In another aspect, the variant transferase, e.g., transaminase, e.g., d-amino-acid transferase, and/or oxidoreductase, e.g., dehydrogenase, e.g., d-amino-acid dehydrogenase polypeptide has increased glycosylation as compared to the transferase, e.g., the transaminase, e.g., the d-amino-acid transferase, and/or the oxidoreductase, e.g., the dehydrogenase, e.g., the d-amino-acid dehydrogenase encoded by a template nucleic acid. Alternatively, the variant transferase, e.g., transaminase, e.g., d-amino-acid transferase, and/or oxidoreductase, e.g., dehydrogenase, e.g., d-amino-acid dehydrogenase polypeptide has a transferase activity, e.g., a transaminase activity, e.g., a d-amino-acid transferase activity, and/or an oxidoreductase activity, e.g., a dehydrogenase activity, e.g., a d-amino-acid dehydrogenase activity under a high temperature, wherein the transferase, e.g., the transaminase, e.g., the d-amino-acid transferase, and/or the oxidoreductase, e.g., the dehydrogenase, e.g., the d-amino-acid dehydrogenase encoded by the template nucleic acid is not active under the high temperature. In one aspect, the method can be iteratively repeated until a transferase, e.g., a transaminase, e.g., a d-amino-acid transferase, and/or an oxidoreductase, e.g., a dehydrogenase, e.g., a d-amino-acid dehydrogenase coding sequence having an altered codon usage from that of the template nucleic acid is produced. In another aspect, the method can be iteratively repeated until a transferase, e.g., a transaminase, e.g., a d-amino-acid transferase, and/or an oxidoreductase, e.g., a dehydrogenase, e.g., a d-amino-acid dehydrogenase gene having higher or lower level of message expression or stability from that of the template nucleic acid is produced. In another aspect, formulation of the final transferase, e.g., transaminase, e.g., d-amino-acid transferase, and/or oxidoreductase, e.g., dehydrogenase, e.g., d-amino-acid dehydrogenase product enables an increase or modulation of the performance of the transferase, e.g., the transaminase, e.g., the d-amino-acid transferase, and/or the oxidoreductase, e.g., the dehydrogenase, e.g., the d-amino-acid dehydrogenase in the product.

The invention provides methods for modifying codons in a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity to increase its expression in a host cell, the method comprising: (a) providing a nucleic acid of the invention encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity; and, (b) identifying a non-preferred or a less preferred codon in the nucleic acid of step (a) and replacing it with a preferred or neutrally used codon encoding the same amino acid as the replaced codon, wherein a preferred codon is a codon overrepresented in coding sequences in genes in the host cell and a non-preferred or less preferred codon is a codon underrepresented in coding sequences in genes in the host cell, thereby modifying the nucleic acid to increase its expression in a host cell.

The invention provides methods for modifying codons in a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity; the method comprising: (a) providing a nucleic acid of the invention; and, (b) identifying a codon in the nucleic acid of step (a) and replacing it with a different codon encoding the same amino acid as the replaced codon, thereby modifying codons in a nucleic acid encoding a transferase, e.g., a transaminase, e.g., a d-amino-acid transferase, and/or an oxidoreductase, e.g., a dehydrogenase, e.g., a d-amino-acid dehydrogenase.

The invention provides methods for modifying codons in a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity to increase its expression in a host cell, the method comprising: (a) providing a nucleic acid of the invention encoding a transferase, e.g., a transaminase, e.g., a d-amino-acid transferase, and/or an oxidoreductase, e.g., a dehydrogenase, e.g., a d-amino-acid dehydrogenase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon overrepresented in coding sequences in genes in the host cell and a non-preferred or less preferred codon is a codon underrepresented in coding sequences in genes in the host cell, thereby modifying the nucleic acid to increase its expression in a host cell.

The invention provides methods for modifying a codon in a nucleic acid encoding a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity to decrease its expression in a host cell, the method comprising: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified transferase, e.g., transaminase, e.g., d-amino-acid transferase, and/or oxidoreductase, e.g., dehydrogenase, e.g., d-amino-acid dehydrogenase active sites or substrate binding sites, wherein the modified active sites or substrate binding sites are derived from a first nucleic acid comprising a sequence encoding a first active site or a first substrate binding site the method comprising: (a) providing a first nucleic acid encoding a first active site or first substrate binding site, wherein the first nucleic acid sequence comprises a sequence that hybridizes under stringent conditions to a sequence of the invention, or a subsequence thereof, and the nucleic acid encodes a transferase, e.g., a transaminase, e.g., a d-amino-acid transferase, and/or an oxidoreductase, e.g., a dehydrogenase, e.g., a d-amino-acid dehydrogenase active site or a transferase, e.g., a transaminase, e.g., a d-amino-acid transferase, and/or an oxidoreductase, e.g., a dehydrogenase, e.g., a d-amino-acid dehydrogenase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified transferase, e.g., transaminase, e.g., d-amino-acid transferase, and/or oxidoreductase e.g., dehydrogenase, e.g., d-amino-acid dehydrogenase active sites or substrate binding sites. In one aspect, the method comprises mutagenizing the first nucleic acid of step (a) by a method comprising an optimized directed evolution system, Gene Site Saturation Mutagenesis (GSSM), or a synthetic ligation reassembly (SLR). In one aspect, the method comprises mutagenizing the first nucleic acid of step (a) or variants by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (GeneReassembly, U.S. Pat. No. 6,537,776), Gene Site Saturation Mutagenesis (GSSM), synthetic ligation reassembly (SLR) and a combination thereof. In one aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising: (a) providing a plurality of biosynthetic enzymes capable of synthesizing or modifying a small molecule, wherein one of the enzymes comprises a transferase, e.g., a transaminase, e.g., a d-amino-acid transferase, and/or an oxidoreductase, e.g., a dehydrogenase, e.g., a d-amino-acid dehydrogenase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising: (a) providing a transferase, e.g., a transaminase, e.g., a d-amino-acid transferase, and/or an oxidoreductase, e.g., a dehydrogenase, e.g., a d-amino-acid dehydrogenase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the transferase, e.g., the transaminase, e.g., the d-amino-acid transferase, and/or the oxidoreductase, e.g., the dehydrogenase, e.g., the d-amino-acid dehydrogenase enzyme, thereby modifying a small molecule by a transferase, e.g., a transaminase, e.g., a d-amino-acid transferase, and/or an oxidoreductase, e.g., a dehydrogenase, e.g., a d-amino-acid dehydrogenase enzymatic reaction. In one aspect, the method can comprise a plurality of small molecule substrates for the enzyme of step (a), thereby generating a library of modified small molecules produced by at least one enzymatic reaction catalyzed by the transferase, e.g., the transaminase, e.g., the d-amino-acid transferase, and/or the oxidoreductase, e.g., the dehydrogenase, e.g., the d-amino-acid dehydrogenase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a transferase, e.g., a transaminase, e.g., a d-amino-acid transferase, and/or an oxidoreductase, e.g., a dehydrogenase, e.g., a d-amino-acid dehydrogenase enzyme comprising the steps of: (a) providing a transferase, e.g., a transaminase, e.g., a d-amino-acid transferase, and/or an oxidoreductase, e.g., a dehydrogenase, e.g., a d-amino-acid dehydrogenase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for a transferase activity, e.g., a transaminase activity, e.g., a d-amino-acid transferase activity, and/or an oxidoreductase activity, e.g., a dehydrogenase activity, e.g., a d-amino-acid dehydrogenase activity, thereby determining a functional fragment of a transferase, e.g., a transaminase, e.g., a d-amino-acid transferase, and/or an oxidoreductase, e.g., a dehydrogenase, e.g., a d-amino-acid dehydrogenase enzyme. In one aspect, the transferase activity, e.g., transaminase activity, e.g., d-amino-acid transferase activity, and/or oxidoreductase activity, e.g., dehydrogenase activity, e.g., d-amino-acid dehydrogenase activity is measured by providing a transferase, e.g., a transaminase, e.g., a d-amino-acid transferase, and/or an oxidoreductase, e.g., a dehydrogenase, e.g., a d-amino-acid dehydrogenase substrate and detecting a decrease in the amount of the substrate or an increase in the amount of a reaction product.

The invention provides methods for whole cell engineering of new or modified phenotypes by using real-time metabolic flux analysis, the method comprising: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides isolated, synthetic or recombinant signal sequences consisting of, or comprising, a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43 or 1 to 44, of a polypeptide of the invention, including exemplary polypeptide sequences of the invention.

The invention provides chimeric polypeptides comprising at least a first domain comprising a signal peptide (SP) and at least a second domain comprising a heterologous polypeptide or peptide comprising a sequence of the invention, or a subsequence thereof, wherein the heterologous polypeptide or peptide is not naturally associated with the signal peptide (SP). In one aspect, the signal peptide (SP) is not derived from a transferase, e.g., a transaminase, e.g., a d-amino-acid transferase, and/or an oxidoreductase, e.g., a dehydrogenase, e.g., a d-amino-acid dehydrogenase. The heterologous polypeptide or peptide can be amino terminal to, carboxy terminal to or on both ends of the signal peptide (SP) or a transferase, e.g., a transaminase, e.g., a d-amino-acid transferase, and/or an oxidoreductase, e.g., a dehydrogenase, e.g., a d-amino-acid dehydrogenase catalytic domain (CD). The invention provides isolated, synthetic or recombinant nucleic acids encoding a chimeric polypeptide, wherein the chimeric polypeptide comprises at least a first domain comprising signal peptide (SP) and at least a second domain comprising a heterologous polypeptide or peptide comprising a sequence of the invention, or a subsequence thereof, wherein the heterologous polypeptide or peptide is not naturally associated with the signal peptide (SP).

The invention provides methods of increasing thermotolerance or thermostability of a transferase, e.g., a transaminase, e.g., a d-amino-acid transferase, and/or an oxidoreductase, e.g., a dehydrogenase, e.g., a d-amino-acid dehydrogenase polypeptide, the method comprising glycosylating a transferase, e.g., a transaminase, e.g., a d-amino-acid transferase, and/or an oxidoreductase, e.g., a dehydrogenase, e.g., a d-amino-acid dehydrogenase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the transferase, e.g., the transaminase, e.g., the d-amino-acid transferase, and/or the oxidoreductase, e.g., the dehydrogenase, e.g., the d-amino-acid dehydrogenasepolypeptide. In one aspect, the transferase, e.g., the transaminase, e.g., the d-amino-acid transferase, and/or the oxidoreductase, e.g., the dehydrogenase, e.g., the d-amino-acid dehydrogenasespecific activity can be thermostable or thermotolerant at a temperature in the range from greater than about 0° C. to about 20° C., about 20° C. to about 37° C., about 37° C. to about 50° C., about 50° C. to about 70° C., about 70° C. to about 75° C., about 75° C. to about 80° C., about 80° C. to about 85° C., about 85° C. to about 90° C., about 90° C. to about 95° C., about 95° C. to about 100° C., about 100° C. to about 110° C., or higher.

The invention provides methods for overexpressing a recombinant transferase, e.g., transaminase, e.g., d-amino-acid transferase, and/or oxidoreductase, e.g., dehydrogenase, e.g., d-amino-acid dehydrogenase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant and seeds comprising: (a) introducing a heterologous nucleic acid sequence into the cell, wherein the heterologous nucleic sequence comprises a nucleic acid sequence of the invention, thereby producing a transformed plant or seed cell; and (b) producing a transgenic plant from the transformed cell or seed. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides detergent compositions comprising a polypeptide of the invention, or a polypeptide encoded by a nucleic acid of the invention, wherein the polypeptide has a transferase activity, e.g., a transaminase activity, e.g., a d-amino-acid transferase activity, and/or an oxidoreductase activity, e.g., a dehydrogenase activity, e.g., a d-amino-acid dehydrogenase activity. The transferase, e.g., transaminase, e.g., d-amino-acid transferase, and/or oxidoreductase, e.g., dehydrogenase, e.g., d-amino-acid dehydrogenase can be nonsurface-active or surface-active. The transferase, e.g., the transaminase, e.g., the d-amino-acid transferase, and/or the oxidoreductase, e.g., the dehydrogenase, e.g., the d-amino-acid dehydrogenase can be formulated in a non-aqueous liquid composition, a cast solid, a granular form, a particulate form, a compressed tablet, a gel form, a paste or a slurry form. The invention provides methods for washing an object comprising: (a) providing a composition comprising a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a polypeptide encoded by a nucleic acid of the invention; (b) providing an object; and (c) contacting the polypeptide of step (a) and the object of step (b) under conditions wherein the composition can wash the object.

The invention provides textiles or fabrics, including, e.g., threads, comprising a polypeptide of the invention, or a polypeptide encoded by a nucleic acid of the invention. The invention provides methods for treating a textile or fabric (e.g., removing a stain from a composition) comprising: (a) providing a composition comprising a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a polypeptide encoded by a nucleic acid of the invention; (b) providing a textile or fabric; and (c) contacting the polypeptide of step (a) and the composition of step (b) under conditions wherein the transferase, e.g., the transaminase, e.g., the d-amino-acid transferase, and/or the oxidoreductase, e.g., the dehydrogenase, e.g., the d-amino-acid dehydrogenase can treat the textile or fabric (e.g., remove the stain). The invention provides methods for improving the finish of a fabric comprising: (a) providing a composition comprising a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a polypeptide encoded by a nucleic acid of the invention; (b) providing a fabric; and (c) contacting the polypeptide of step (a) and the fabric of step (b) under conditions wherein the polypeptide can treat the fabric thereby improving the finish of the fabric. In one aspect, the fabric is a wool or a silk. In another aspect, the fabric is a cellulosic fiber or a blend of a natural fiber and a synthetic fiber.

The invention provides feeds, foods, feed supplements, food supplements, dietary compositions or dietary aids comprising a polypeptide of the invention, or a polypeptide encoded by a nucleic acid of the invention. The food or the feed can be, e.g., a cereal, a grain, a corn and the like.

The invention provides dough, bread or baked products and/or dough, bread or baked product precursors comprising a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide comprises a sequence of the invention, or the polypeptide is encoded by a nucleic acid comprising a sequence of the invention, or an enzymatically active fragment thereof.

The invention provides beverages and beverage precursors comprising a polypeptide, or an enzymatically active fragment thereof, having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide comprises a sequence of the invention, or the polypeptide is encoded by a nucleic acid comprising a sequence of the invention. The invention provides methods of beverage production comprising administration of at least one polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide comprises a sequence of the invention, or the polypeptide is encoded by a nucleic acid comprising a sequence of the invention, or an enzymatically active fragment thereof, to a beverage or a beverage precursor, wherein in one aspect (optionally) the beverage or beverage precursor is a wort or a beer.

The invention provides food, feed or nutritional supplements, e.g. for a human or an animal comprising a polypeptide of the invention, e.g., a polypeptide encoded by the nucleic acid of the invention. In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the transferase activity, e.g., transaminase activity, e.g., d-amino-acid transferase activity, and/or oxidoreductase activity, e.g., dehydrogenase activity, e.g., d-amino-acid dehydrogenase activity is thermotolerant. In another aspect, the transferase activity, e.g., transaminase activity, e.g., d-amino-acid transferase activity, and/or oxidoreductase activity, e.g., dehydrogenase activity, e.g., d-amino-acid dehydrogenase activity is thermostable.

In one aspect, the transferase, e.g., the transaminase, e.g., the d-amino-acid transferase, and/or the oxidoreductase, e.g., the dehydrogenase, e.g., the d-amino-acid dehydrogenase enzyme can be prepared by expression of a polynucleotide encoding the transferase, e.g., the transaminase, e.g., the d-amino-acid transferase, and/or the oxidoreductase, e.g., the dehydrogenase, e.g., the d-amino-acid dehydrogenase in an organism selected from the group consisting of a bacterium, a yeast, a plant, an insect, a fungus and an animal. The organism can be selected from the group consisting of an *S. pombe, S. cerevisiae, Pichia pastoris, Pseudomonas* sp., *E. coli, Streptomyces* sp., *Bacillus* sp. and *Lactobacillus* sp.

The invention provides edible enzyme delivery matrix comprising a thermostable recombinant transferase, e.g., transaminase, e.g., d-amino-acid transferase, and/or oxidoreductase, e.g., dehydrogenase, e.g., d-amino-acid dehydrogenase enzyme, e.g., a polypeptide of the invention. The invention provides methods for delivering a transferase, e.g., a transaminase, e.g., a d-amino-acid transferase, and/or an oxidoreductase, e.g., a dehydrogenase, e.g., a d-amino-acid dehydrogenase supplement to an animal, the method comprising: preparing an edible enzyme delivery matrix in the form of pellets comprising a granulate edible carrier and a thermostable recombinant transferase, e.g., transaminase, e.g., d-amino-acid transferase, and/or oxidoreductase, e.g., dehydrogenase, e.g., d-amino-acid dehydrogenase enzyme, wherein the pellets readily disperse the transferase, e.g., the transaminase, e.g., the d-amino-acid transferase, and/or the oxidoreductase, e.g., the dehydrogenase, e.g., the d-amino-acid dehydrogenase enzyme contained therein into aqueous media, and administering the edible enzyme delivery matrix to the animal. The recombinant transferase, e.g., transaminase, e.g., d-amino-acid transferase, and/or oxidoreductase, e.g., dehydrogenase, e.g., d-amino-acid dehydrogenase enzyme can comprise a polypeptide of the invention. The granulate edible carrier can comprise a carrier selected from the group consisting of a grain germ, a grain germ that is spent of oil, a hay, an alfalfa, a timothy, a soy hull, a sunflower seed meal and a wheat midd. The edible carrier can comprise grain germ that is spent of oil. The transferase, e.g., the transaminase, e.g., the d-amino-acid transferase, and/or the oxidoreductase, e.g., the dehydrogenase, e.g., the d-amino-acid dehydrogenase enzyme can be glycosylated to provide thermostability at pelletizing conditions. The delivery matrix can be formed by pelletizing a mixture comprising a grain germ and a transferase, e.g., a transaminase, e.g., a d-amino-acid transferase, and/or an oxidoreductase, e.g., a dehydrogenase, e.g., a d-amino-acid dehydrogenase. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

The invention provides methods for treating, e.g. improving texture and flavor of a dairy product comprising: (a) providing a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention; (b) providing a dairy product; and (c) contacting the polypeptide of step (a) and the dairy product of step (b) under conditions wherein the transferase, e.g., the transaminase, e.g., the d-amino-acid transferase, and/or the oxidoreductase, e.g., the dehydrogenase, e.g., the d-amino-acid dehydrogenase can treat, e.g. improve the texture or flavor of the dairy product. In one aspect, the dairy product comprises a cheese or a yogurt. The invention provides dairy products comprising a transferase, e.g., a transaminase, e.g., a d-amino-acid transferase, and/or an oxidoreductase, e.g., a dehydrogenase, e.g., a d-amino-acid dehydrogenase of the invention, or is encoded by a nucleic acid of the invention.

The invention provides methods for improving the extraction of oil from an oil-rich plant material comprising: (a) providing a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention; (b) providing an oil-rich plant material; and (c) contacting the polypeptide of step (a) and the oil-rich plant material. In one aspect, the oil-rich plant material comprises an oil-rich seed. The oil can be a soybean oil, an olive oil, a rapeseed (canola) oil or a sunflower oil.

The invention provides methods for preparing a fruit or vegetable juice, syrup, puree or extract comprising: (a) providing a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention; (b) providing a composition or a liquid comprising a fruit or vegetable material; and (c) contacting the polypeptide of step (a) and the composition, thereby preparing the fruit or vegetable juice, syrup, puree or extract.

The invention provides methods for treating a wood, a wood product, a paper, a paper product, a pulp, a pulp product, a paper waste or a paper recycling composition comprising: (a) providing a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention; (b) providing a composition comprising a wood, a wood product, a paper, a paper product, a pulp, a pulp product, a paper waste or a paper recycling composition; and (c) contacting the polypeptide of step (a) and the composition, thereby treating the wood, wood product, paper, paper product, pulp, pulp product, paper waste or paper recycling composition. In one aspect of the invention, the treatment comprises reducing or solubilizing lignin (delignification), bleaching or decoloring, and/or deinking.

The invention provides papers or paper products or paper pulp comprising a transferase, e.g., a transaminase, e.g., a d-amino-acid transferase, and/or an oxidoreductase, e.g., a dehydrogenase, e.g., a d-amino-acid dehydrogenase of the invention, or a polypeptide encoded by a nucleic acid of the invention. The invention provides methods for treating a paper or a paper or wood pulp comprising: (a) providing a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention; (b) providing a composition comprising a paper or a paper or wood pulp; and (c) contacting the polypeptide of step (a) and the composition of step (b) under conditions wherein the transferase, e.g., the transaminase, e.g., the d-amino-acid transferase, and/or the oxidoreductase, e.g., the dehydrogenase, e.g., the d-amino-acid dehydrogenase can treat the paper or paper or wood pulp.

The invention provides methods for bleaching a thread, fabric, yarn, cloth or textile comprising contacting the fabric, yarn, cloth or textile with a transferase, e.g., a transaminase, e.g., a d-amino-acid transferase, and/or an oxidoreductase, e.g., a dehydrogenase, e.g., a d-amino-acid dehydrogenase under conditions suitable to produce a whitening of the textile, wherein the transferase, e.g., the transaminase, e.g., the d-amino-acid transferase, and/or the oxidoreductase, e.g., the dehydrogenase, e.g., the d-amino-acid dehydrogenase comprises a polypeptide of the invention, or an enzymatically active fragment thereof. The thread, fabric, yarn, cloth or textile can comprise a non-cotton cellulosic thread, fabric, yarn, cloth or textile. The invention provides fabrics, yarns, cloths or textiles comprising a polypeptide having a sequence of the invention, or a polypeptide encoded by a nucleic acid comprising a sequence of the invention, or an enzymatically active fragment thereof, wherein in one aspect (optionally) the fabric, yarn, cloth or textile comprises a non-cotton cellulosic fabric, yarn, cloth or textile.

The invention provides wood, wood chips, wood pulp, wood products, paper pulps, paper products, newspapers or paper waste comprising a polypeptide of the invention, or an enzymatically active fragment thereof. The invention provides thread, fabric, yarn, cloth or textile comprising a polypeptide of the invention, or an enzymatically active fragment thereof.

The invention provides methods for making ethanol comprising contacting an organic material, e.g. a biomass, with a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide has a sequence of the invention, or the polypeptide is encoded by a nucleic acid comprising a sequence of the invention, or an enzymatically active fragment thereof. The invention provides compositions comprising an ethanol and a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide has a sequence of the invention, or the polypeptide is encoded by a nucleic acid comprising a sequence of the invention, or an enzymatically active fragment thereof. The invention provides methods for making ethanol comprising: (a) providing at least one polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or an enzymatically active fragment thereof; (b) providing an organic composition; and (c) contacting the composition of step (b) with the polypeptide of step (a).

The invention provides pharmaceutical compositions comprising a polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, wherein the polypeptide comprises a sequence of the invention, or the polypeptide is encoded by a nucleic acid comprising a sequence of the invention, or an enzymatically active fragment thereof. In one aspect, the pharmaceutical composition acts as a digestive aid or is used for the diagnosis, tracking or treatment of any condition and/or disease, e.g. liver damage/disease or myocardial infarctions. In one aspect, the treatment is prophylactic.

In one aspect, the invention provides oral care products comprising a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention. The oral care product can comprise a toothpaste, a dental cream, a gel or a tooth powder, an odontic, a mouth wash, a pre- or post brushing rinse formulation, a chewing gum, a lozenge or a candy. The invention provides contact lens cleaning compositions comprising a polypeptide of the invention having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or a transferase, e.g., a transaminase, e.g., a d-amino-acid transferase, and/or an oxidoreductase, e.g., a dehydrogenase, e.g., a d-amino-acid dehydrogenase encoded by a nucleic acid of the invention.

The invention provides chimeric transferases, e.g., transaminases, e.g., d-amino-acid transferases, and/or oxidoreductases, e.g., dehydrogenases, e.g., d-amino-acid dehydrogenases comprising a polypeptide sequence of the invention and at least one heterologous binding domain, wherein in one aspect (optionally) the binding domain comprises a NAD, a NAD(P), a calcium, a thiamine, a FAD, a zinc, a DNA and/or a lipoyl binding domain. The invention provides methods for designing a chimeric transferase, e.g., transaminase, e.g., d-amino-acid transferase, and/or oxidoreductase, e.g., dehydrogenase, e.g., d-amino-acid dehydrogenase having a new binding specificity or an enhanced binding specificity, comprising inserting a heterologous or an additional endogenous binding domain into a transferase, e.g., a transaminase, e.g., a d-amino-acid transferase, and/or an oxidoreductase, e.g., a dehydrogenase, e.g., a d-amino-acid dehydrogenase, wherein the binding domain comprises a binding subsequence of a transferase, e.g., a transaminase, e.g., a d-amino-acid transferase, and/or an oxidoreductase, e.g., a dehydrogenase, e.g., a d-amino-acid dehydrogenase sequence of the invention, or alternatively a heterologous binding domain, or an additional endogenous binding domain, is inserted into a transferase, e.g., a transaminase, e.g., a d-amino-acid transferase, and/or an oxidoreductase, e.g., a dehydrogenase, e.g., a d-amino-acid dehydrogenase sequence of the invention.

The invention provides enzyme mixtures, or "cocktails" comprising at least one enzyme of the invention and one or more other enzyme(s), which can be another transferase, e.g., transaminase, e.g., d-amino-acid transferase, and/or oxidoreductase, e.g., dehydrogenase, e.g., d-amino-acid dehydrogenase, or any other enzyme; for example, the "cocktails" of the invention, in addition to at least one enzyme of this invention, can comprise any other enzyme, such as xylanase, cellulases, lipases, esterases, proteases, or endoglycosidases, endo-beta.-1,4-glucanases, beta-glucanases, endo-beta-1,3 (4)-glucanases, cutinases, peroxidases, catalases, laccases, amylases, glucoamylases, pectinases, racemases, isomerases, epimerases, dehydrogenases, oxidoreductases, reductases, oxidases, phenoloxidases, ligninases, pullulanases, arabinanases, hemicellulases, mannanases, xyloglucanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases, to name just a few examples. In alternative embodiments, these enzyme mixtures, or "cocktails" comprising at least one enzyme of the invention can be used in any process or method of the invention, or composition of the invention, e.g., in foods or feeds, food or feed supplements, textiles, papers, processed woods, etc. and methods for making them, and in compositions and methods for treating paper, pulp, wood, paper, pulp or wood waste or by-products, and the like, and in the final products thereof.

The invention provides methods of making a pyruvate and/or a D-glutamate comprising (a) providing a D-alanine and a 2-oxoglutarate; (b) providing the polypeptide of the invention; and (c) contacting the polypeptide of (b) with the D-alanine+2-oxoglutarate under conditions wherein the polypeptide catalyzes the reaction D-alanine+2-oxoglutarate<=>pyruvate+D-glutamate.

The invention provides methods of making a 2-oxo acid comprising (i) (a) providing a D-amino acid+$H_2O$+acceptor; (b) providing the transaminase polypeptide of the invention; and (c) contacting the polypeptide of (b) with the D-amino acid+$H_2O$+acceptor, under conditions wherein the polypeptide catalyzes the reaction: D-amino acid+$H_2O$+acceptor<=>a 2-oxo acid+NH3+reduced acceptor; or (ii) the method of (i), wherein the acceptor is a benzoquinone is (iii) the method of (ii) wherein the benzoquinone is a 1,2-benzoquinone or a 1,4-benzoquinone, or ubiquinone, ubidecarenone or coenzyme Q.

The invention provides methods for transferring an amino group from an amino acid to an alpha-keto acid comprising (i) (a) providing an amino acid; (b) providing the transaminase polypeptide of the invention; and (c) contacting the polypeptide of (b) with the amino acid under conditions wherein the polypeptide catalyzes the conversion of the amino acid to an alpha-keto acid; or (ii) the method of (i), wherein the transaminase activity comprises catalyzing the conversion of a racemic amino acid mixture to a substantially optically pure alpha-keto acid.

The invention provides methods for transferring making an amino acid from an alpha-keto acid comprising (i) (a) providing an alpha-keto acid (b) providing the transaminase polypeptide of the invention; and (c) contacting the polypeptide of (b) with the alpha-keto acid under conditions wherein the polypeptide catalyzes the conversion of the alpha-keto acid to an amino acid; (ii) the method of (i), wherein the transaminase activity comprises catalyzing the conversion of a racemic alpha-keto mixture to a substantially optically pure D- or L-amino acid; or (iii) the method of (i) or (ii), wherein oxaloacetate is converted to an aspartate, or α-ketoglutarate is converted to glutarate, or an α-ketoisovalerate is converted to an L-valine; or the transaminase activity is an omega transaminase activity that catalyzes the conversion of isobutylamine to isobutyraldehyde.

The invention provides methods for catalyzing the conversion of an amine to a ketone comprising (i) (a) providing an amine; (b) providing the transaminase polypeptide of the invention; and (c) contacting the polypeptide of (b) with the amine under conditions wherein the polypeptide catalyzes the conversion of an amine to a ketone, wherein the amine is not in or from a tryptophan (with the proviso that the second amino acid is not tryptophan, or with the proviso that the amine is not in or from a tryptophan); (ii) the method of (i), wherein the transaminase activity comprises catalyzing the conversion of a chiral amine to a ketone; or (iii) the method of (i) or (ii), wherein the amine is a ω-amine.

The invention provides methods of catalyzing the synthesis of an amino acid comprising (i) (a) providing amino acid and a keto acid, wherein the amino acid is not tryptophan; (b) providing the transaminase polypeptide of the invention; and (c) contacting the polypeptide of (b) with the amino acid and keto acid under conditions wherein a second amino acid and a pyruvate is produced, wherein the second amino acid is not tryptophan (with the proviso that the second amino acid is not tryptophan); or (ii) the method of (i), further comprising reacting the pyruvate with an acetolactate synthase enzyme under conditions appropriate to produce a compound that does not react with transaminase enzyme; (iii) the method of (ii), wherein the compound that does not react with transaminase enzyme is acetolactate or acetoin; or, the first amino acid is alanine or L-aspartate; or, the keto acid is 2-ketobutyrate or tri-methyl pyruvate; or, the second amino acid is 2-aminobutyrate or tert-leucine.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF THE DRAWINGS

The following drawings are illustrative of aspects of the invention and are not meant to limit the scope of the invention as encompassed by the claims.

FIG. 5 illustrates a comparison of sequences of this invention, showing the consensus regions of the SEQ ID NO:894 like proteins, as highlighted in the figure, as described in detail in Example 9, below.

FIG. 6 illustrates a comparison of the enzyme sequence of this invention SEQ ID NO:910, with other published DATS, and as highlighted in the figure, one can see the residues that make this enzyme unique and may account for its superior activity, as described in detail in Example 10, below.

FIG. 7 illustrates a comparison of related D-aminotransferases and the core sequence motifs they have in common, as described in detail in Example 14, below.

Like reference symbols in the various drawings indicate like elements.

DETAILED DESCRIPTION OF THE INVENTION

Figure 1:
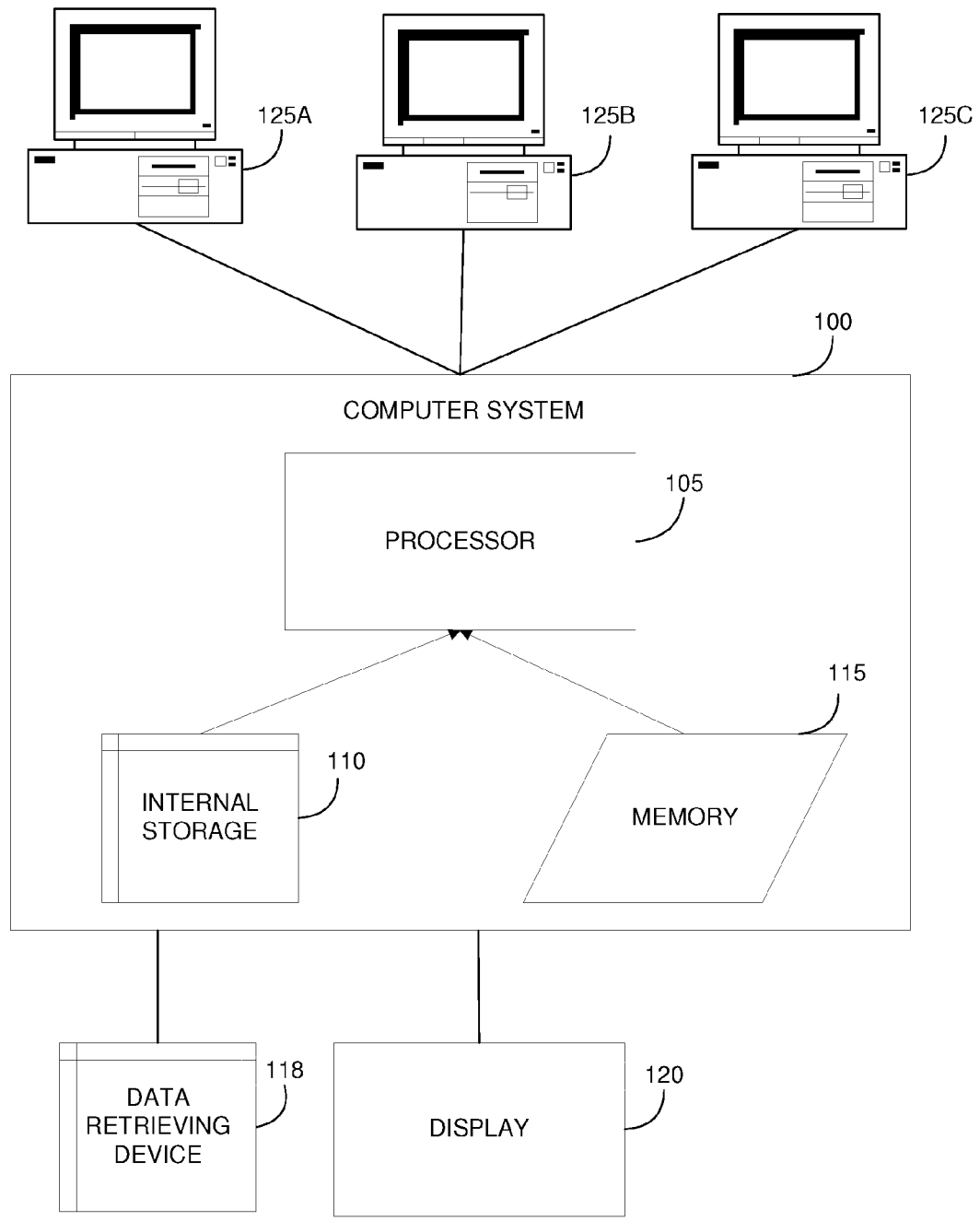
FIG. 1 is a block diagram of a computer system.

The invention provides transferases, e.g., transaminases, e.g., d-amino-acid transferases (also referred to as "d-aminotransferases" or "D-ATs" or "DATs"), and/or oxidoreductases, e.g., dehydrogenases, e.g., d-amino-acid dehydrogenases, and polynucleotides encoding them and methods of making and using them. Transferases, e.g., transaminases, e.g., d-amino-acid transferases, and/or oxidoreductases, e.g., dehydrogenases, e.g., d-amino-acid dehydrogenases, of the polypeptides of the invention encompasses enzymes having transferase activity, e.g., transaminase activity, e.g., d-amino-acid transferase activity, and/or oxidoreductase activity, e.g., dehydrogenase activity, e.g., d-amino-acid dehydrogenase activity, and/or catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+H2O+acceptor<=>a 2-oxo acid+NH3+reduced acceptor. The transferases and/or oxidoreductases of the invention can be used to make and/or process pharmaceutical (drug) compositions, pharmaceutical (drug) precursors and/or intermediates, antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, detergents and the like.

In one aspect, an enzyme of the invention is thermotolerant and/or tolerant of high and/or low pH conditions. For example, in one aspect, a transferase, e.g., a transaminase, e.g., a d-amino-acid transferase, and/or an oxidoreductase, e.g., a dehydrogenase, e.g., a d-amino-acid dehydrogenase of the invention retains activity under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, or more.

The invention provides isolated, synthetic or recombinant nucleic acids comprising a nucleic acid encoding at least one polypeptide having a transferase activity, e.g., a transaminase activity, e.g., a d-amino-acid transferase activity, and/or an oxidoreductase activity, e.g., a dehydrogenase activity, e.g., a d-amino-acid dehydrogenase activity, or other activity as described herein, wherein the nucleic acid comprises a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ ID NO:515, SEQ ID NO:517, SEQ ID NO:519, SEQ ID NO:521, SEQ ID NO:523, SEQ ID NO:525, SEQ ID NO:527, SEQ ID NO:529, SEQ ID NO:531, SEQ ID NO:533, SEQ ID NO:535, SEQ ID NO:537, SEQ ID NO:539, SEQ ID NO:541, SEQ ID NO:543, SEQ ID NO:545, SEQ ID NO:547, SEQ ID NO:549, SEQ ID NO:551, SEQ ID NO:553, SEQ ID NO:555, SEQ ID NO:557, SEQ ID NO:559, SEQ ID NO:561, SEQ ID NO:563, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:589, SEQ ID NO:591, SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619, SEQ ID NO:621, SEQ ID NO:623, SEQ ID NO:625, SEQ ID NO:627, SEQ ID NO:629, SEQ ID NO:631, SEQ ID NO:633, SEQ ID NO:635, SEQ ID NO:637, SEQ ID NO:639, SEQ ID NO:641, SEQ ID NO:643, SEQ ID NO:645, SEQ ID NO:647, SEQ ID NO:649, SEQ ID NO:651, SEQ ID NO:653, SEQ ID NO:655, SEQ ID NO:657, SEQ ID NO:659, SEQ ID NO:661, SEQ ID NO:663, SEQ ID NO:665, SEQ ID NO:667, SEQ ID NO:669, SEQ ID NO:671, SEQ ID NO:673, SEQ ID NO:675, SEQ ID NO:677, SEQ ID NO:679, SEQ ID NO:681, SEQ ID NO:683, SEQ ID NO:685, SEQ ID NO:687, SEQ ID NO:689, SEQ ID NO:691, SEQ ID NO:693, SEQ ID NO:695, SEQ ID NO:697, SEQ ID NO:699, SEQ ID NO:701, SEQ ID NO:703, SEQ ID NO:705, SEQ ID NO:707, SEQ ID NO:709, SEQ ID NO:711, SEQ ID NO:713, SEQ ID NO:715, SEQ ID NO:717, SEQ ID NO:719, SEQ ID NO:721, SEQ ID NO:723, SEQ ID NO:725, SEQ ID NO:727, SEQ ID NO:729, SEQ ID NO:731, SEQ ID NO:733, SEQ ID NO:735, SEQ ID NO:737, SEQ ID NO:739, SEQ ID NO:741, SEQ ID NO:743, SEQ ID NO:745, SEQ ID NO:747, SEQ ID NO:749, SEQ ID NO:751, SEQ ID NO:753, SEQ ID NO:755, SEQ ID NO:757, SEQ ID NO:759, SEQ ID NO:761, SEQ ID NO:763, SEQ ID NO:765, SEQ ID NO:767, SEQ ID NO:769, SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, SEQ ID NO:791, SEQ ID NO:793, SEQ ID NO:795, SEQ ID NO:797, SEQ ID NO:799, SEQ ID NO:801, SEQ ID NO:803, SEQ ID NO:805, SEQ ID NO:807, SEQ ID NO:809, SEQ ID NO:811, SEQ ID NO:813, SEQ ID NO:815, SEQ ID NO:817, SEQ ID NO:819, SEQ ID NO:821, SEQ ID NO:823, SEQ ID NO:825, SEQ ID NO:827, SEQ ID NO:829, SEQ ID NO:831, SEQ ID NO:833, SEQ ID NO:835, SEQ ID NO:837, SEQ ID NO:839, SEQ ID NO:841, SEQ ID NO:843, SEQ ID NO:845, SEQ ID NO:847, SEQ ID NO:849, SEQ ID NO:851, SEQ ID NO:853, SEQ ID NO:855, SEQ ID NO:857, SEQ ID NO:859, SEQ ID NO:861, SEQ ID NO:863, SEQ ID NO:865, SEQ ID NO:867, SEQ ID NO:869, SEQ ID NO:871, SEQ ID NO:873, SEQ ID NO:875, SEQ ID NO:877, SEQ ID NO:879, SEQ ID NO:881, SEQ ID NO:883, SEQ ID NO:885, SEQ ID NO:887, SEQ ID NO:889, SEQ ID NO:891, SEQ ID NO:893, SEQ ID NO:895, SEQ ID NO:897, SEQ ID NO:899, SEQ ID NO:901, SEQ ID NO:903, SEQ ID NO:905, SEQ ID NO:907, SEQ ID NO:909, SEQ ID NO:911, SEQ ID NO:913, SEQ ID NO:915, SEQ ID NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, SEQ ID NO:941, SEQ ID NO:943, SEQ ID NO:945, SEQ ID NO:947, SEQ ID NO:949, SEQ ID NO:951, SEQ ID NO:953, SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, and/or SEQ ID NO:975, and as described herein and in Tables 1, 2 and 3, and the Sequence Listing (all of these sequences are "exemplary polynucleotides of the invention"), and enzymatically active subsequences (fragments) thereof, over a region of between about 10 to 2500, or more residues, or the full length of a cDNA, transcript (mRNA) or gene. Nucleic acids of the invention includes those encoding a polypeptide of this invention, having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, or 100% (complete) sequence identity to an exemplary polypeptide of the invention, which includes, e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976, including the sequences described herein and in Tables 1, 2 and 3, below, and in the Sequence Listing (all of these sequences are "exemplary enzymes/polypeptides of the invention"), and enzymatically active subsequences (fragments) thereof.

Tables 1, 2 and 3, below, are charts describing selected characteristics of exemplary nucleic acids and polypeptides of the invention, including sequence identity comparison of the exemplary sequences to public databases.

Table 1, below, describes the assigned activity (as determined by experimental data, see Examples 1 through 23 of the exemplary polypeptides (encoded by the exemplary polynucleotides) of the invention. Table 1 further indicates whether the polynucleotide (encoding a polypeptide) of the invention is a clone (a genomic sequence isolated from the original source, as described in Table 2) or is a subclone (where the clone is manipulated by, e.g. removal of a native signal sequence, addition of a start Methionine, addition of a tag, etc). Table 1 also indicates the clone and subclone relationship, e.g. which subclone was derived from which clone. For aid in reading Table 1, for example, Columns 1 and 4, rows 1 and 2, indicate that SEQ ID NO:32 (encoded by SEQ ID NO:31) is a clone with the corresponding subclone being SEQ ID NO:868 (encoded by SEQ ID NO:867), denoted as "Clone/subclone pair 1".

Table 2, below, indicates the source from which the exemplary nucleic acids and polypeptides of the invention were first derived. Table 2, below, also indicates the "Signalp Cleavage Site" for the exemplary enzyme's signal sequence (or "signal peptide", or SP), as determined by the paradigm Signalp, as discussed below (see Nielsen (1997), infra); the "Predicted Signal Sequence" is listed from the amino terminal to the carboxy terminal, for example, for the polypeptide SEQ ID NO:258, the signal peptide is "MKSAIVLGAGMVGIATAVHL".

Table 3, below describes selected characteristics of exemplary nucleic acids and polypeptides of the invention, including sequence identity comparison of the exemplary sequences to public databases. To further aid in reading Table 3, for example, the first row, labeled "SEQ ID NO:", the numbers "1, 2" represent the exemplary polypeptide of the invention having a sequence as set forth in SEQ ID NO:2, encoded by, e.g., SEQ ID NO:1. All sequences described in Table 2 (all the exemplary sequences of the invention) have been subject to a BLAST search (as described in detail, below) against two sets of databases. The first database set is available through NCBI (National Center for Biotechnology Information). All results from searches against these databases are found in the columns entitled "NR Description", "NR Accession Code", "NR Evalue" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR Evalue" refer to the Expect value (Evalue), which represents the probability that an alignment score as good as the one found between the query sequence (the sequences of the invention) and a database sequence would be found in the same number of comparisons between random sequences as was done in the present BLAST search. The entries in the column "NR Organism" refer to the source organism of the sequence identified as the closest BLAST hit. The second set of databases is collectively known as the GENESEQ™ database, which is available through Thomson Derwent (Philadelphia, Pa.). All results from searches against this database are found in the columns entitled "GENESEQ™ Protein Description", "GENESEQ™ Protein Accession Code", "Evalue", "GENESEQ™ DNA Description", "GENESEQ™ DNA Accession Code" or "Evalue". The information found in these columns is comparable to the information found in the NR columns described above, except that it was derived from BLAST searches against the GENESEQ™ database instead of the NCBI databases. In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an Evalue equal to or less than e-6, the EC number assigned to the top match is entered into the table. The EC number of the top hit is used as a guide to what the EC number of the sequence of the invention might be. The columns "Query DNA Length" and "Query Protein Length" refer to the number of nucleotides or the number amino acids, respectively, in the sequence of the invention that was searched or queried against either the NCBI or GENESEQ™ databases. The columns "Subject DNA Length" and "Subject Protein Length" refer to the number of nucleotides or the number amino acids, respectively, in the sequence of the top match from the BLAST searches. The results provided in these columns are from the search that returned the lower Evalue, either from the NCBI databases or the Geneseq database. The columns "% ID Protein" and "% ID DNA" refer to the percent sequence identity between the sequence of the invention and the sequence of the top BLAST match. The results provided in these columns are from the search that returned the lower Evalue, either from the NCBI databases or the GENESEQ™ database.

TABLE 1

| Clone/subclone pair | SEQ ID NO: | Activity | Sequence type (clone or subclone) |
|---|---|---|---|
| 1 | 31, 32 | D-AT | Clone |
| 1 | 867, 868 | D-AT | Subclone |
| 2 | 955, 956 | D-AT | Clone |
| 2 | 929, 930 | D-AT | Subclone |
| 3 | 957, 958 | D-AT | Clone |
| 3 | 931, 932 | D-AT | Subclone |
| 4 | 959, 960 | D-AT | Clone |
| 4 | 935, 936 | D-AT | Subclone |
| 5 | 41, 42 | D-AT | Clone |
| 5 | 869, 870 | D-AT | Subclone |
| 6 | 7, 8 | D-AT | Clone |
| 6 | 943, 944 | D-AT | Subclone |
| 7 | 11, 12 | D-AT | Clone |
| 7 | 941, 942 | D-AT | Subclone |
| 8 | 83, 84 | D-AT | Clone |
| 8 | 879, 880 | D-AT | Subclone |
| 9 | 151, 152 | D-AT | Clone |
| 9 | 913, 914 | D-AT | Subclone |
| 10 | 951, 952 | D-AT | Clone |
| 10 | 933, 934 | D-AT | Subclone |
| 11 | 75, 76 | D-AT | Clone |
| 11 | 881, 882 | D-AT | Subclone |
| 12 | 87, 88 | D-AT | Clone |
| 12 | 883, 884 | D-AT | Subclone |
| 13 | 163, 164 | D-AT | Clone |
| 13 | 921, 922 | D-AT | Subclone |
| 14 | 145, 146 | D-AT | Clone |
| 14 | 919, 920 | D-AT | Subclone |
| 15 | 149, 150 | D-AT | Clone |
| 15 | 925, 926 | D-AT | Subclone |
| 16 | 147, 148 | D-AT | Clone |
| 16 | 915, 916 | D-AT | Subclone |
| 17 | 15, 16 | D-AT | Clone |
| 17 | 947, 948 | D-AT | Subclone |
| 18 | 17, 18 | D-AT | Clone |
| 18 | 949, 950 | D-AT | Subclone |
| 19 | 3, 4 | D-AT | Clone |
| 19 | 937, 938 | D-AT | Subclone |
| 20 | 5, 6 | D-AT | Clone |
| 20 | 939, 940 | D-AT | Subclone |
| 21 | 161, 162 | D-AT | Clone |
| 21 | 923, 924 | D-AT | Subclone |
| 22 | 953, 954 | D-AT | Clone |
| 22 | 927, 928 | D-AT | Subclone |
| 23 | 19, 20 | D-AT | Clone |
| 23 | 885, 886 | D-AT | Subclone |
| 24 | 21, 22 | D-AT | Clone |
| 24 | 891, 892 | D-AT | Subclone |
| 25 | 23, 24 | D-AT | Clone |
| 25 | 893, 894 | D-AT | Subclone |
| 26 | 13, 14 | D-AT | Clone |
| 26 | 945, 946 | D-AT | Subclone |
| 27 | 143, 144 | D-AT | Clone |
| 27 | 917, 918 | D-AT | Subclone |
| 28 | 43, 44 | D-AT | Clone |
| 28 | 871, 872 | D-AT | Subclone |
| 29 | 45, 46 | D-AT | Clone |
| 29 | 873, 874 | D-AT | Subclone |
| 30 | 49, 50 | D-AT | Clone |
| 30 | 897, 898 | D-AT | Subclone |
| 31 | 51, 52 | D-AT | Clone |
| 31 | 875, 876 | D-AT | Subclone |
| 32 | 37, 38 | D-AT | Clone |
| 32 | 877, 878 | D-AT | Subclone |
| 33 | 25, 26 | D-AT | Clone |
| 33 | 889, 890 | D-AT | Subclone |
| 34 | 27, 28 | D-AT | Clone |
| 34 | 887, 888 | D-AT | Subclone |
| 35 | 131, 132 | D-AT | Clone |
| 35 | 909, 910 | D-AT | Subclone |
| 36 | 53, 54 | D-AT | Clone |
| 36 | 865, 866 | D-AT | Subclone |
| 37 | 29, 30 | D-AT | Clone |
| 37 | 895, 896 | D-AT | Subclone |
| 38 | 125, 126 | D-AT | Clone |
| 38 | 907, 908 | D-AT | Subclone |
| 39 | 133, 134 | D-AT | Clone |

TABLE 1-continued

| Clone/subclone pair | SEQ ID NO: | Activity | Sequence type (clone or subclone) |
|---|---|---|---|
| 39 | 911, 912 | D-AT | Subclone |
| 40 | 127, 128 | D-AT | Clone |
| 40 | 899, 900 | D-AT | Subclone |
| 41 | 137, 138 | D-AT | Clone |
| 41 | 901, 902 | D-AT | Subclone |
| 42 | 139, 140 | D-AT | Clone |
| 42 | 903, 904 | D-AT | Subclone |
| 43 | 129, 130 | D-AT | Clone |
| 43 | 905, 906 | D-AT | Subclone |
| 44 | 33, 34 | D-AT | Clone |
| 44 | 969, 970 | D-AT | Subclone |
| 45 | 219, 220 | D-AT | Clone |
| 45 | 973, 974 | D-AT | Subclone |
| 46 | 39, 40 | D-AT | Clone |
| 46 | 971, 972 | D-AT | Subclone |
| 47 | 1, 2 | D-AT | Clone |
| 47 | 975, 976 | D-AT | Subclone |
| 48 | 253, 254 | Dehydrogenase | Clone |
| 48 | 961, 962 | Dehydrogenase | Subclone |
| 48 | 963, 964 | Dehydrogenase | Subclone |
| 48 | 965, 966 | Dehydrogenase | Subclone |
| 48 | 967, 968 | Dehydrogenase | Subclone |
|  | 35, 36 | D-AT | Clone |
|  | 9, 10 | D-AT | Clone |
|  | 85, 86 | D-AT | Clone |
|  | 77, 78 | D-AT | Clone |
|  | 153, 154 | D-AT | Clone |
|  | 155, 156 | D-AT | Clone |
|  | 201, 202 | D-AT | Clone |
|  | 221, 222 | D-AT | Clone |
|  | 235, 236 | D-AT | Clone |
|  | 203, 204 | D-AT | Clone |
|  | 237, 238 | D-AT | Clone |
|  | 239, 240 | D-AT | Clone |
|  | 159, 160 | D-AT | Clone |
|  | 165, 166 | D-AT | Clone |
|  | 211, 212 | D-AT | Clone |
|  | 249, 250 | D-AT | Clone |
|  | 177, 178 | D-AT | Clone |
|  | 223, 224 | D-AT | Clone |
|  | 169, 170 | D-AT | Clone |
|  | 179, 180 | D-AT | Clone |
|  | 181, 182 | D-AT | Clone |
|  | 63, 64 | D-AT | Clone |
|  | 107, 108 | D-AT | Clone |
|  | 109, 110 | D-AT | Clone |
|  | 111, 112 | D-AT | Clone |
|  | 113, 114 | D-AT | Clone |
|  | 115, 116 | D-AT | Clone |
|  | 123, 124 | D-AT | Clone |
|  | 225, 226 | D-AT | Clone |
|  | 227, 228 | D-AT | Clone |
|  | 247, 248 | D-AT | Clone |
|  | 217, 218 | D-AT | Clone |
|  | 205, 206 | D-AT | Clone |
|  | 183, 184 | D-AT | Clone |
|  | 185, 186 | D-AT | Clone |
|  | 241, 242 | D-AT | Clone |
|  | 243, 244 | D-AT | Clone |
|  | 229, 230 | D-AT | Clone |
|  | 231, 232 | D-AT | Clone |
|  | 187, 188 | D-AT | Clone |
|  | 189, 190 | D-AT | Clone |
|  | 191, 192 | D-AT | Clone |
|  | 207, 208 | D-AT | Clone |
|  | 99, 100 | D-AT | Clone |
|  | 55, 56 | D-AT | Clone |
|  | 57, 58 | D-AT | Clone |
|  | 193, 194 | D-AT | Clone |
|  | 233, 234 | D-AT | Clone |
|  | 215, 216 | D-AT | Clone |
|  | 195, 196 | D-AT | Clone |
|  | 199, 200 | D-AT | Clone |
|  | 197, 198 | D-AT | Clone |
|  | 209, 210 | D-AT | Clone |
|  | 141, 142 | D-AT | Clone |
|  | 157, 158 | D-AT | Clone |
|  | 245, 246 | D-AT | Clone |
|  | 59, 60 | D-AT | Clone |
|  | 61, 62 | D-AT | Clone |
|  | 47, 48 | D-AT | Clone |
|  | 213, 214 | D-AT | Clone |
|  | 171, 172 | D-AT | Clone |
|  | 167, 168 | D-AT | Clone |
|  | 173, 174 | D-AT | Clone |
|  | 175, 176 | D-AT | Clone |
|  | 65, 66 | D-AT | Clone |
|  | 67, 68 | D-AT | Clone |
|  | 69, 70 | D-AT | Clone |
|  | 71, 72 | D-AT | Clone |
|  | 73, 74 | D-AT | Clone |
|  | 79, 80 | D-AT | Clone |
|  | 81, 82 | D-AT | Clone |
|  | 93, 94 | D-AT | Clone |
|  | 91, 92 | D-AT | Clone |
|  | 95, 96 | D-AT | Clone |
|  | 97, 98 | D-AT | Clone |
|  | 117, 118 | D-AT | Clone |
|  | 119, 120 | D-AT | Clone |
|  | 121, 122 | D-AT | Clone |
|  | 101, 102 | D-AT | Clone |
|  | 103, 104 | D-AT | Clone |
|  | 105, 106 | D-AT | Clone |
|  | 89, 90 | D-AT | Clone |
|  | 135, 136 | D-AT | Clone |
|  | 259, 260 | Dehydrogenase | Clone |
|  | 261, 262 | Dehydrogenase | Clone |
|  | 263, 264 | Dehydrogenase | Clone |
|  | 327, 328 | Dehydrogenase | Clone |
|  | 335, 336 | Dehydrogenase | Clone |
|  | 353, 354 | Dehydrogenase | Clone |
|  | 355, 356 | Dehydrogenase | Clone |
|  | 321, 322 | Dehydrogenase | Clone |
|  | 341, 342 | Dehydrogenase | Clone |
|  | 265, 266 | Dehydrogenase | Clone |
|  | 287, 288 | Dehydrogenase | Clone |
|  | 267, 268 | Dehydrogenase | Clone |
|  | 269, 270 | Dehydrogenase | Clone |
|  | 301, 302 | Dehydrogenase | Clone |
|  | 413, 414 | Dehydrogenase | Clone |
|  | 433, 434 | Dehydrogenase | Clone |
|  | 423, 424 | Dehydrogenase | Clone |
|  | 303, 304 | Dehydrogenase | Clone |
|  | 425, 426 | Dehydrogenase | Clone |
|  | 393, 394 | Dehydrogenase | Clone |
|  | 297, 298 | Dehydrogenase | Clone |
|  | 299, 300 | Dehydrogenase | Clone |
|  | 567, 568 | Dehydrogenase | Clone |
|  | 515, 516 | Dehydrogenase | Clone |
|  | 465, 466 | Dehydrogenase | Clone |
|  | 387, 388 | Dehydrogenase | Clone |
|  | 409, 410 | Dehydrogenase | Clone |
|  | 411, 412 | Dehydrogenase | Clone |
|  | 375, 376 | Dehydrogenase | Clone |
|  | 407, 408 | Dehydrogenase | Clone |
|  | 391, 392 | Dehydrogenase | Clone |
|  | 485, 486 | Dehydrogenase | Clone |
|  | 603, 604 | Dehydrogenase | Clone |
|  | 605, 606 | Dehydrogenase | Clone |
|  | 517, 518 | Dehydrogenase | Clone |
|  | 543, 544 | Dehydrogenase | Clone |
|  | 429, 430 | Dehydrogenase | Clone |
|  | 443, 444 | Dehydrogenase | Clone |
|  | 365, 366 | Dehydrogenase | Clone |
|  | 445, 446 | Dehydrogenase | Clone |
|  | 431, 432 | Dehydrogenase | Clone |
|  | 449, 450 | Dehydrogenase | Clone |
|  | 467, 468 | Dehydrogenase | Clone |
|  | 379, 380 | Dehydrogenase | Clone |
|  | 367, 368 | Dehydrogenase | Clone |
|  | 405, 406 | Dehydrogenase | Clone |
|  | 383, 384 | Dehydrogenase | Clone |
|  | 357, 358 | Dehydrogenase | Clone |
|  | 415, 416 | Dehydrogenase | Clone |

TABLE 1-continued

| Clone/subclone pair | SEQ ID NO: | Activity | Sequence type (clone or subclone) |
|---|---|---|---|
| | 395, 396 | Dehydrogenase | Clone |
| | 385, 386 | Dehydrogenase | Clone |
| | 369, 370 | Dehydrogenase | Clone |
| | 397, 398 | Dehydrogenase | Clone |
| | 435, 436 | Dehydrogenase | Clone |
| | 453, 454 | Dehydrogenase | Clone |
| | 469, 470 | Dehydrogenase | Clone |
| | 447, 448 | Dehydrogenase | Clone |
| | 473, 474 | Dehydrogenase | Clone |
| | 389, 390 | Dehydrogenase | Clone |
| | 427, 428 | Dehydrogenase | Clone |
| | 451, 452 | Dehydrogenase | Clone |
| | 399, 400 | Dehydrogenase | Clone |
| | 455, 456 | Dehydrogenase | Clone |
| | 417, 418 | Dehydrogenase | Clone |
| | 403, 404 | Dehydrogenase | Clone |
| | 419, 420 | Dehydrogenase | Clone |
| | 251, 252 | Dehydrogenase | Clone |
| | 371, 372 | Dehydrogenase | Clone |
| | 475, 476 | Dehydrogenase | Clone |
| | 457, 458 | Dehydrogenase | Clone |
| | 459, 460 | Dehydrogenase | Clone |
| | 461, 462 | Dehydrogenase | Clone |
| | 463, 464 | Dehydrogenase | Clone |
| | 477, 478 | Dehydrogenase | Clone |
| | 479, 480 | Dehydrogenase | Clone |
| | 481, 482 | Dehydrogenase | Clone |
| | 629, 630 | Dehydrogenase | Clone |
| | 519, 520 | Dehydrogenase | Clone |
| | 521, 522 | Dehydrogenase | Clone |
| | 589, 590 | Dehydrogenase | Clone |
| | 359, 360 | Dehydrogenase | Clone |
| | 361, 362 | Dehydrogenase | Clone |
| | 381, 382 | Dehydrogenase | Clone |
| | 363, 364 | Dehydrogenase | Clone |
| | 625, 626 | Dehydrogenase | Clone |
| | 549, 550 | Dehydrogenase | Clone |
| | 551, 552 | Dehydrogenase | Clone |
| | 501, 502 | Dehydrogenase | Clone |
| | 571, 572 | Dehydrogenase | Clone |
| | 601, 602 | Dehydrogenase | Clone |
| | 573, 574 | Dehydrogenase | Clone |
| | 575, 576 | Dehydrogenase | Clone |
| | 577, 578 | Dehydrogenase | Clone |
| | 611, 612 | Dehydrogenase | Clone |
| | 579, 580 | Dehydrogenase | Clone |
| | 523, 524 | Dehydrogenase | Clone |
| | 553, 554 | Dehydrogenase | Clone |
| | 503, 504 | Dehydrogenase | Clone |
| | 505, 506 | Dehydrogenase | Clone |
| | 507, 508 | Dehydrogenase | Clone |
| | 509, 510 | Dehydrogenase | Clone |
| | 525, 526 | Dehydrogenase | Clone |
| | 373, 374 | Dehydrogenase | Clone |
| | 421, 422 | Dehydrogenase | Clone |
| | 483, 484 | Dehydrogenase | Clone |
| | 511, 512 | Dehydrogenase | Clone |
| | 527, 528 | Dehydrogenase | Clone |
| | 555, 556 | Dehydrogenase | Clone |
| | 529, 530 | Dehydrogenase | Clone |
| | 591, 592 | Dehydrogenase | Clone |
| | 557, 558 | Dehydrogenase | Clone |
| | 559, 560 | Dehydrogenase | Clone |
| | 593, 594 | Dehydrogenase | Clone |
| | 581, 582 | Dehydrogenase | Clone |
| | 613, 614 | Dehydrogenase | Clone |
| | 595, 596 | Dehydrogenase | Clone |
| | 597, 598 | Dehydrogenase | Clone |
| | 599, 600 | Dehydrogenase | Clone |
| | 583, 584 | Dehydrogenase | Clone |
| | 615, 616 | Dehydrogenase | Clone |
| | 619, 620 | Dehydrogenase | Clone |
| | 621, 622 | Dehydrogenase | Clone |
| | 561, 562 | Dehydrogenase | Clone |
| | 563, 564 | Dehydrogenase | Clone |
| | 587, 588 | Dehydrogenase | Clone |
| | 513, 514 | Dehydrogenase | Clone |
| | 531, 532 | Dehydrogenase | Clone |
| | 533, 534 | Dehydrogenase | Clone |
| | 535, 536 | Dehydrogenase | Clone |
| | 585, 586 | Dehydrogenase | Clone |
| | 617, 618 | Dehydrogenase | Clone |
| | 627, 628 | Dehydrogenase | Clone |
| | 623, 624 | Dehydrogenase | Clone |
| | 537, 538 | Dehydrogenase | Clone |
| | 565, 566 | Dehydrogenase | Clone |
| | 539, 540 | Dehydrogenase | Clone |
| | 541, 542 | Dehydrogenase | Clone |
| | 569, 570 | Dehydrogenase | Clone |
| | 607, 608 | Dehydrogenase | Clone |
| | 609, 610 | Dehydrogenase | Clone |
| | 487, 488 | Dehydrogenase | Clone |
| | 545, 546 | Dehydrogenase | Clone |
| | 495, 496 | Dehydrogenase | Clone |
| | 497, 498 | Dehydrogenase | Clone |
| | 499, 500 | Dehydrogenase | Clone |
| | 489, 490 | Dehydrogenase | Clone |
| | 491, 492 | Dehydrogenase | Clone |
| | 493, 494 | Dehydrogenase | Clone |
| | 547, 548 | Dehydrogenase | Clone |
| | 401, 402 | Dehydrogenase | Clone |
| | 377, 378 | Dehydrogenase | Clone |
| | 437, 438 | Dehydrogenase | Clone |
| | 439, 440 | Dehydrogenase | Clone |
| | 441, 442 | Dehydrogenase | Clone |
| | 271, 272 | Dehydrogenase | Clone |
| | 273, 274 | Dehydrogenase | Clone |
| | 293, 294 | Dehydrogenase | Clone |
| | 275, 276 | Dehydrogenase | Clone |
| | 277, 278 | Dehydrogenase | Clone |
| | 279, 280 | Dehydrogenase | Clone |
| | 281, 282 | Dehydrogenase | Clone |
| | 283, 284 | Dehydrogenase | Clone |
| | 285, 286 | Dehydrogenase | Clone |
| | 291, 292 | Dehydrogenase | Clone |
| | 289, 290 | Dehydrogenase | Clone |
| | 255, 256 | Dehydrogenase | Clone |
| | 295, 296 | Dehydrogenase | Clone |
| | 257, 258 | Dehydrogenase | Clone |
| | 471, 472 | Dehydrogenase | Clone |
| | 323, 324 | Dehydrogenase | Clone |
| | 325, 326 | Dehydrogenase | Clone |
| | 305, 306 | Dehydrogenase | Clone |
| | 331, 332 | Dehydrogenase | Clone |
| | 343, 344 | Dehydrogenase | Clone |
| | 345, 346 | Dehydrogenase | Clone |
| | 337, 338 | Dehydrogenase | Clone |
| | 309, 310 | Dehydrogenase | Clone |
| | 307, 308 | Dehydrogenase | Clone |
| | 347, 348 | Dehydrogenase | Clone |
| | 329, 330 | Dehydrogenase | Clone |
| | 339, 340 | Dehydrogenase | Clone |
| | 311, 312 | Dehydrogenase | Clone |
| | 313, 314 | Dehydrogenase | Clone |
| | 315, 316 | Dehydrogenase | Clone |
| | 317, 318 | Dehydrogenase | Clone |
| | 349, 350 | Dehydrogenase | Clone |
| | 351, 352 | Dehydrogenase | Clone |
| | 333, 334 | Dehydrogenase | Clone |
| | 319, 320 | Dehydrogenase | Clone |
| | 675, 676 | Oxidoreductase | Clone |
| | 671, 672 | Oxidoreductase | Clone |
| | 673, 674 | Oxidoreductase | Clone |
| | 643, 644 | Oxidoreductase | Clone |
| | 645, 646 | Oxidoreductase | Clone |
| | 647, 648 | Oxidoreductase | Clone |
| | 649, 650 | Oxidoreductase | Clone |
| | 663, 664 | Oxidoreductase | Clone |
| | 807, 808 | Oxidoreductase | Clone |
| | 697, 698 | Oxidoreductase | Clone |
| | 699, 700 | Oxidoreductase | Clone |
| | 837, 838 | Oxidoreductase | Clone |
| | 715, 716 | Oxidoreductase | Clone |
| | 717, 718 | Oxidoreductase | Clone |

TABLE 1-continued

| Clone/subclone pair | SEQ ID NO: | Activity | Sequence type (clone or subclone) |
|---|---|---|---|
| | 701, 702 | Oxidoreductase | Clone |
| | 687, 688 | Oxidoreductase | Clone |
| | 703, 704 | Oxidoreductase | Clone |
| | 719, 720 | Oxidoreductase | Clone |
| | 709, 710 | Oxidoreductase | Clone |
| | 711, 712 | Oxidoreductase | Clone |
| | 713, 714 | Oxidoreductase | Clone |
| | 689, 690 | Oxidoreductase | Clone |
| | 681, 682 | Oxidoreductase | Clone |
| | 705, 706 | Oxidoreductase | Clone |
| | 721, 722 | Oxidoreductase | Clone |
| | 809, 810 | Oxidoreductase | Clone |
| | 811, 812 | Oxidoreductase | Clone |
| | 813, 814 | Oxidoreductase | Clone |
| | 815, 816 | Oxidoreductase | Clone |
| | 839, 840 | Oxidoreductase | Clone |
| | 695, 696 | Oxidoreductase | Clone |
| | 707, 708 | Oxidoreductase | Clone |
| | 791, 792 | Oxidoreductase | Clone |
| | 745, 746 | Oxidoreductase | Clone |
| | 747, 748 | Oxidoreductase | Clone |
| | 855, 856 | Oxidoreductase | Clone |
| | 857, 858 | Oxidoreductase | Clone |
| | 859, 860 | Oxidoreductase | Clone |
| | 861, 862 | Oxidoreductase | Clone |
| | 863, 864 | Oxidoreductase | Clone |
| | 773, 774 | Oxidoreductase | Clone |
| | 723, 724 | Oxidoreductase | Clone |
| | 775, 776 | Oxidoreductase | Clone |
| | 633, 634 | Oxidoreductase | Clone |
| | 635, 636 | Oxidoreductase | Clone |
| | 749, 750 | Oxidoreductase | Clone |
| | 725, 726 | Oxidoreductase | Clone |
| | 825, 826 | Oxidoreductase | Clone |
| | 751, 752 | Oxidoreductase | Clone |
| | 777, 778 | Oxidoreductase | Clone |
| | 683, 684 | Oxidoreductase | Clone |
| | 685, 686 | Oxidoreductase | Clone |
| | 753, 754 | Oxidoreductase | Clone |
| | 755, 756 | Oxidoreductase | Clone |
| | 779, 780 | Oxidoreductase | Clone |
| | 827, 828 | Oxidoreductase | Clone |
| | 781, 782 | Oxidoreductase | Clone |
| | 757, 758 | Oxidoreductase | Clone |
| | 829, 830 | Oxidoreductase | Clone |
| | 851, 852 | Oxidoreductase | Clone |
| | 849, 850 | Oxidoreductase | Clone |
| | 817, 818 | Oxidoreductase | Clone |
| | 831, 832 | Oxidoreductase | Clone |
| | 793, 794 | Oxidoreductase | Clone |
| | 823, 824 | Oxidoreductase | Clone |
| | 843, 844 | Oxidoreductase | Clone |
| | 845, 846 | Oxidoreductase | Clone |
| | 819, 820 | Oxidoreductase | Clone |
| | 759, 760 | Oxidoreductase | Clone |
| | 783, 784 | Oxidoreductase | Clone |
| | 785, 786 | Oxidoreductase | Clone |
| | 833, 834 | Oxidoreductase | Clone |
| | 835, 836 | Oxidoreductase | Clone |
| | 795, 796 | Oxidoreductase | Clone |
| | 797, 798 | Oxidoreductase | Clone |
| | 799, 800 | Oxidoreductase | Clone |
| | 801, 802 | Oxidoreductase | Clone |
| | 761, 762 | Oxidoreductase | Clone |
| | 803, 804 | Oxidoreductase | Clone |
| | 805, 806 | Oxidoreductase | Clone |
| | 763, 764 | Oxidoreductase | Clone |
| | 765, 766 | Oxidoreductase | Clone |
| | 767, 768 | Oxidoreductase | Clone |
| | 769, 770 | Oxidoreductase | Clone |
| | 771, 772 | Oxidoreductase | Clone |
| | 787, 788 | Oxidoreductase | Clone |
| | 789, 790 | Oxidoreductase | Clone |
| | 841, 842 | Oxidoreductase | Clone |
| | 729, 730 | Oxidoreductase | Clone |
| | 731, 732 | Oxidoreductase | Clone |
| | 733, 734 | Oxidoreductase | Clone |
| | 735, 736 | Oxidoreductase | Clone |
| | 727, 728 | Oxidoreductase | Clone |
| | 691, 692 | Oxidoreductase | Clone |
| | 693, 694 | Oxidoreductase | Clone |
| | 847, 848 | Oxidoreductase | Clone |
| | 853, 854 | Oxidoreductase | Clone |
| | 651, 652 | Oxidoreductase | Clone |
| | 653, 654 | Oxidoreductase | Clone |
| | 655, 656 | Oxidoreductase | Clone |
| | 657, 658 | Oxidoreductase | Clone |
| | 659, 660 | Oxidoreductase | Clone |
| | 661, 662 | Oxidoreductase | Clone |
| | 637, 638 | Oxidoreductase | Clone |
| | 631, 632 | Oxidoreductase | Clone |
| | 639, 640 | Oxidoreductase | Clone |
| | 641, 642 | Oxidoreductase | Clone |
| | 737, 738 | Oxidoreductase | Clone |
| | 739, 740 | Oxidoreductase | Clone |
| | 821, 822 | Oxidoreductase | Clone |
| | 741, 742 | Oxidoreductase | Clone |
| | 743, 744 | Oxidoreductase | Clone |
| | 679, 680 | Oxidoreductase | Clone |
| | 665, 666 | Oxidoreductase | Clone |
| | 667, 668 | Oxidoreductase | Clone |
| | 669, 670 | Oxidoreductase | Clone |
| | 677, 678 | Oxidoreductase | Clone |

TABLE 2

| SEQ ID NO: | Source | Signalp Cleavage Site | Predicted Signal Sequence |
|---|---|---|---|
| 1, 2 | Unknown | | |
| 3, 4 | Unknown | | |
| 5, 6 | Unknown | | |
| 7, 8 | Unknown | | |
| 9, 10 | Unknown | | |
| 11, 12 | Unknown | | |
| 13, 14 | Unknown | | |
| 15, 16 | Unknown | | |
| 17, 18 | Unknown | | |

TABLE 2-continued

| SEQ ID NO: | Source | Signalp Cleavage Site | Predicted Signal Sequence |
|---|---|---|---|
| 19, 20 | Unknown | | |
| 21, 22 | Unknown | | |
| 23, 24 | Unknown | | |
| 25, 26 | Unknown | | |
| 27, 28 | Unknown | | |
| 29, 30 | Unknown | | |
| 31, 32 | Unknown | | |
| 33, 34 | Unknown | | |
| 35, 36 | Unknown | | |
| 37, 38 | Unknown | | |
| 39, 40 | Unknown | | |
| 41, 42 | Unknown | | |
| 43, 44 | Unknown | | |
| 45, 46 | Unknown | | |
| 47, 48 | Unknown | | |
| 49, 50 | Unknown | | |
| 51, 52 | Unknown | | |
| 53, 54 | Unknown | | |
| 55, 56 | Unknown | | |
| 57, 58 | Unknown | | |
| 59, 60 | Unknown | | |
| 61, 62 | Unknown | | |
| 63, 64 | Unknown | | |
| 65, 66 | Unknown | | |
| 67, 68 | Unknown | | |
| 69, 70 | Unknown | | |
| 71, 72 | Unknown | | |
| 73, 74 | Unknown | | |
| 75, 76 | Unknown | | |
| 77, 78 | Unknown | | |
| 79, 80 | Unknown | | |
| 81, 82 | Unknown | | |
| 83, 84 | Unknown | | |
| 85, 86 | Unknown | | |
| 87, 88 | Unknown | | |
| 89, 90 | Unknown | | |
| 91, 92 | Unknown | | |
| 93, 94 | Unknown | | |

TABLE 2-continued

| SEQ ID NO: | Source | Signalp Cleavage Site | Predicted Signal Sequence |
|---|---|---|---|
| 95, 96 | Unknown | | |
| 97, 98 | Unknown | | |
| 99, 100 | Unknown | | |
| 101, 102 | Unknown | | |
| 103, 104 | Unknown | | |
| 105, 106 | Unknown | | |
| 107, 108 | Unknown | | |
| 109, 110 | Unknown | | |
| 111, 112 | Unknown | | |
| 113, 114 | Unknown | | |
| 115, 116 | Unknown | | |
| 117, 118 | Unknown | | |
| 119, 120 | Unknown | | |
| 121, 122 | Unknown | | |
| 123, 124 | Unknown | | |
| 125, 126 | Unknown | | |
| 127, 128 | Unknown | | |
| 129, 130 | Unknown | | |
| 131, 132 | Unknown | | |
| 133, 134 | Unknown | | |
| 135, 136 | Unknown | | |
| 137, 138 | Unknown | | |
| 139, 140 | Unknown | | |
| 141, 142 | Unknown | | |
| 143, 144 | Unknown | | |
| 145, 146 | Unknown | | |
| 147, 148 | Unknown | | |
| 149, 150 | Unknown | | |
| 151, 152 | Unknown | | |
| 153, 154 | Unknown | | |
| 155, 156 | Unknown | Probability: 0.991 AA1: 19 AA2: 20 | KNSPIIAAYRAATPGSAAA |
| 157, 158 | Unknown | | |
| 159, 160 | Unknown | | |
| 161, 162 | Unknown | | |
| 163, 164 | Unknown | | |
| 165, 166 | Unknown | | |
| 167, 168 | Unknown | | |
| 169, 170 | *Rhodococcus* | | |

TABLE 2-continued

| SEQ ID NO: | Source | Signalp Cleavage Site | Predicted Signal Sequence |
|---|---|---|---|
| | erythropolis DSMZ 44522 | | |
| 171, 172 | Unknown | | |
| 173, 174 | Unknown | | |
| 175, 176 | Unknown | | |
| 177, 178 | Unknown | | |
| 179, 180 | Unknown | | |
| 181, 182 | Unknown | | |
| 183, 184 | Unknown | | |
| 185, 186 | Unknown | | |
| 187, 188 | Unknown | | |
| 189, 190 | Unknown | | |
| 191, 192 | Unknown | | |
| 193, 194 | Unknown | | |
| 195, 196 | Unknown | | |
| 197, 198 | Unknown | | |
| 199, 200 | Unknown | | |
| 201, 202 | Unknown | | |
| 203, 204 | Unknown | | |
| 205, 206 | Unknown | | |
| 207, 208 | Unknown | | |
| 209, 210 | Unknown | | |
| 211, 212 | Unknown | | |
| 213, 214 | Unknown | | |
| 215, 216 | Unknown | | |
| 217, 218 | Unknown | | |
| 219, 220 | Unknown | | |
| 221, 222 | Unknown | | |
| 223, 224 | Unknown | | |
| 225, 226 | Unknown | | |
| 227, 228 | Unknown | | |
| 229, 230 | Unknown | | |
| 231, 232 | Unknown | | |
| 233, 234 | Unknown | | |
| 235, 236 | Unknown | | |
| 237, 238 | Unknown | | |
| 239, 240 | Unknown | | |
| 241, 242 | Unknown | | |
| 243, 244 | Unknown | | |

TABLE 2-continued

| SEQ ID NO: | Source | Signalp Cleavage Site | Predicted Signal Sequence |
|---|---|---|---|
| 245, 246 | Unknown | | |
| 247, 248 | Unknown | | |
| 249, 250 | Unknown | | |
| 251, 252 | Unknown | | |
| 253, 254 | Unknown | | |
| 255, 256 | Unknown | | |
| 257, 258 | Unknown | Probability: 0.612 AA1: 20 AA2: 21 | MKSAIVLGAGMVGIATAVHL |
| 259, 260 | Unknown | | |
| 261, 262 | Unknown | | |
| 263, 264 | Unknown | | |
| 265, 266 | Unknown | | |
| 267, 268 | Unknown | | |
| 269, 270 | Unknown | | |
| 271, 272 | Unknown | Probability: 0.836 AA1: 22 AA2: 23 | MKPTSILVLGAGMVGTCTALHL |
| 273, 274 | Unknown | | |
| 275, 276 | Unknown | | |
| 277, 278 | Unknown | | |
| 279, 280 | Unknown | | |
| 281, 282 | Unknown | | |
| 283, 284 | Unknown | Probability: 0.549 AA1: 20 AA2: 21 | MKAIVLGSGVLGTTTAYYLA |
| 285, 286 | Unknown | Probability: 0.957 AA1: 24 AA2: 25 | MARPRSVIICGGGIIGLCTAYSLA |
| 287, 288 | Unknown | | |
| 289, 290 | Unknown | | |
| 291, 292 | Unknown | | |
| 293, 294 | Unknown | | |
| 295, 296 | Unknown | | |
| 297, 298 | Unknown | Probability: 0.898 AA1: 21 AA2: 22 | MQSIAVIGGGITGVTSAYALA |
| 299, 300 | Unknown | Probability: 0.898 AA1: 21 AA2: 22 | MQSIAVIGGGITGVTSAYALA |
| 301, 302 | Unknown | | |
| 303, 304 | Unknown | Probability: 0.945 AA1: 18 AA2: 19 | MKVLVLGAGVVGTATALA |

TABLE 2-continued

| SEQ ID NO: | Source | Signalp Cleavage Site | Predicted Signal Sequence |
|---|---|---|---|
| 305, 306 | Unknown | | |
| 307, 308 | Unknown | | |
| 309, 310 | Unknown | | |
| 311, 312 | Unknown | | |
| 313, 314 | Unknown | | |
| 315, 316 | Unknown | | |
| 317, 318 | Unknown | | |
| 319, 320 | Unknown | Probability: 0.725 AA1: 25 AA2: 26 | MKSARPVKTVGIAGAGTMGRGIAAA |
| 321, 322 | Unknown | | |
| 323, 324 | Unknown | | |
| 325, 326 | Unknown | Probability: 0.552 AA1: 20 AA2: 21 | MRVLVLGSGVIGTASAYYLA |
| 327, 328 | Unknown | | |
| 329, 330 | Unknown | | |
| 331, 332 | Unknown | | |
| 333, 334 | Unknown | Probability: 0.725 AA1: 25 AA2: 26 | MKSARPVKTVGIAGAGTMGRGIAAA |
| 335, 336 | Unknown | | |
| 337, 338 | Unknown | | |
| 339, 340 | Unknown | | |
| 341, 342 | Unknown | | |
| 343, 344 | Unknown | | |
| 345, 346 | Unknown | | |
| 347, 348 | Unknown | | |
| 349, 350 | Unknown | | |
| 351, 352 | Unknown | | |
| 353, 354 | Unknown | Probability: 0.791 AA1: 24 AA2: 25 | MRQSRSVIICGGGVIGLSCAYYLA |
| 355, 356 | Unknown | | |
| 357, 358 | Unknown | | |
| 359, 360 | Rhodococcus ruber DSMZ 44319 | | |
| 361, 362 | Rhodococcus ruber DSMZ 44319 | | |
| 363, 364 | Rhodococcus ruber DSMZ 44319 | | |

TABLE 2-continued

| SEQ ID NO: | Source | Signalp Cleavage Site | Predicted Signal Sequence |
|---|---|---|---|
| 365, 366 | Unknown | | |
| 367, 368 | Unknown | | |
| 369, 370 | Unknown | | |
| 371, 372 | Unknown | | |
| 373, 374 | Unknown | | |
| 375, 376 | Unknown | | |
| 377, 378 | Unknown | | |
| 379, 380 | Unknown | | |
| 381, 382 | *Rhodococcus ruber* DSMZ 44319 | | |
| 383, 384 | Unknown | Probability: 0.657 AA1: 21 AA2: 22 | MMKIMVLGGGVIGVTTAYYLA |
| 385, 386 | Unknown | | |
| 387, 388 | Unknown | Probability: 0.930 AA1: 20 AA2: 21 | MRIVVLGAGVVGTTAAYCLA |
| 389, 390 | Unknown | | |
| 391, 392 | Unknown | Probability: 0.711 AA1: 20 AA2: 21 | MSSTRRVIVIGGGVIGAASA |
| 393, 394 | Unknown | Probability: 0.968 AA1: 18 AA2: 19 | MKILVIGAGVIGVATAWA |
| 395, 396 | Unknown | Probability: 0.638 AA1: 20 AA2: 21 | MTKDIVVLGAGVVGVCTALA |
| 397, 398 | Unknown | | |
| 399, 400 | Unknown | | |
| 401, 402 | Unknown | Probability: 0.999 AA1: 18 AA2: 19 | MKTLVLGGGIAGLSSAFA |
| 403, 404 | Unknown | Probability: 0.959 AA1: 20 AA2: 21 | MSKKGTSVIIGGGISGLASA |
| 405, 406 | Unknown | | |
| 407, 408 | Unknown | | |
| 409, 410 | Unknown | | |
| 411, 412 | Unknown | | |
| 413, 414 | Unknown | | |
| 415, 416 | Unknown | | |
| 417, 418 | Unknown | Probability: 0.709 AA1: 20 AA2: 21 | MKITILGAGVIGVTSAYYLA |
| 419, 420 | Unknown | | |
| 421, 422 | Unknown | | |

TABLE 2-continued

| SEQ ID NO: | Source | Signalp Cleavage Site | Predicted Signal Sequence |
|---|---|---|---|
| 423, 424 | Unknown | | |
| 425, 426 | Unknown | | |
| 427, 428 | Unknown | | |
| 429, 430 | Unknown | | |
| 431, 432 | Unknown | | |
| 433, 434 | Unknown | | |
| 435, 436 | Unknown | Probability: 0.738 AA1: 22 AA2: 23 | MPGTVDAIVLGAGIVGVSAALA |
| 437, 438 | Unknown | | |
| 439, 440 | Unknown | | |
| 441, 442 | Unknown | | |
| 443, 444 | Unknown | | |
| 445, 446 | Unknown | | |
| 447, 448 | Unknown | | |
| 449, 450 | Unknown | Probability: 0.823 AA1: 23 AA2: 24 | MKRDVIVLGAGMVGVGCALHLQA |
| 451, 452 | Unknown | | |
| 453, 454 | Unknown | | |
| 455, 456 | Unknown | | |
| 457, 458 | Unknown | | |
| 459, 460 | Unknown | Probability: 0.950 AA1: 21 AA2: 22 | MQRIAVIGGGITGITSAYALA |
| 461, 462 | Unknown | Probability: 0.557 AA1: 18 AA2: 19 | MPSVLITGATSGFGKAAA |
| 463, 464 | Unknown | | |
| 465, 466 | Unknown | | |
| 467, 468 | Unknown | | |
| 469, 470 | Unknown | | |
| 471, 472 | Unknown | | |
| 473, 474 | Unknown | | |
| 475, 476 | Unknown | | |
| 477, 478 | Unknown | | |
| 479, 480 | Unknown | | |
| 481, 482 | Unknown | | |
| 483, 484 | Unknown | | |
| 485, 486 | Unknown | | |
| 487, 488 | Unknown | | |
| 489, 490 | Unknown | | |
| 491, 492 | Unknown | Probability: | MKISIVGAGLAGLCAAHALVA |

TABLE 2-continued

| SEQ ID NO: | Source | Signalp Cleavage Site | Predicted Signal Sequence |
|---|---|---|---|
| | | 1.000 AA1: 21 AA2: 22 | |
| 493, 494 | Unknown | | |
| 495, 496 | Unknown | | |
| 497, 498 | Unknown | | |
| 499, 500 | Unknown | Probability: 0.852 AA1: 23 AA2: 24 | MKFDVAVLGAGIVGISTALHLQA |
| 501, 502 | Unknown | | |
| 503, 504 | Unknown | | |
| 505, 506 | Unknown | | |
| 507, 508 | Unknown | | |
| 509, 510 | Unknown | | |
| 511, 512 | Unknown | Probability: 0.696 AA1: 28 AA2: 29 | MTEASRTSRQTEVIVLGAGIVGVSTALA |
| 513, 514 | Unknown | | |
| 515, 516 | Unknown | Probability: 0.898 AA1: 21 AA2: 22 | MQSIAVIGGGITGVTSAYALA |
| 517, 518 | Unknown | Probability: 0.798 AA1: 21 AA2: 22 | MKSVIIIGGGIIGLCSAYYLA |
| 519, 520 | Unknown | | |
| 521, 522 | Rhodococcus erythropolis DSMZ 44522 | | |
| 523, 524 | Unknown | Probability: 0.601 AA1: 22 AA2: 23 | MKKKILVIGGGAIGLFCAYYLR |
| 525, 526 | Unknown | | |
| 527, 528 | Unknown | | |
| 529, 530 | Unknown | | |
| 531, 532 | Unknown | | |
| 533, 534 | Unknown | Probability: 0.716 AA1: 24 AA2: 25 | MRNSKSVVVCGGGIVGLCTAYYLA |
| 535, 536 | Unknown | | |
| 537, 538 | Unknown | | |
| 539, 540 | Unknown | | |
| 541, 542 | Unknown | | |
| 543, 544 | Unknown | | |
| 545, 546 | Unknown | | |
| 547, 548 | Unknown | Probability: 0.696 AA1: 24 AA2: 25 | MTDKRRVVVCGGGVIGLCCADSLA |
| 549, 550 | Unknown | | |

TABLE 2-continued

| SEQ ID NO: | Source | Signalp Cleavage Site | Predicted Signal Sequence |
|---|---|---|---|
| 551, 552 | Unknown | | |
| 553, 554 | Unknown | | |
| 555, 556 | Unknown | | |
| 557, 558 | Unknown | | |
| 559, 560 | Unknown | | |
| 561, 562 | Unknown | Probability: 0.765 AA1: 22 AA2: 23 | MDPHVVIAGCGFGGLFAARALA |
| 563, 564 | Unknown | | |
| 565, 566 | Unknown | | |
| 567, 568 | Unknown | | |
| 569, 570 | Unknown | | |
| 571, 572 | Unknown | | |
| 573, 574 | Unknown | Probability: 0.982 AA1: 24 AA2: 25 | MSRPRSVIICGGGIVGLCTAYSLA |
| 575, 576 | Unknown | | |
| 577, 578 | Unknown | | |
| 579, 580 | Unknown | Probability: 0.772 AA1: 20 AA2: 21 | MKITILGAGVIGVTSAYYLA |
| 581, 582 | Unknown | | |
| 583, 584 | Unknown | | |
| 585, 586 | Unknown | | |
| 587, 588 | Unknown | | |
| 589, 590 | Rhodococcus erythropolis DSMZ 44522 | | |
| 591, 592 | Unknown | | |
| 593, 594 | Unknown | | |
| 595, 596 | Unknown | | |
| 597, 598 | Unknown | Probability: 0.672 AA1: 20 AA2: 21 | MKVLVLGGGVIGVSSAYFLA |
| 599, 600 | Unknown | Probability: 0.873 AA1: 20 AA2: 21 | MKVIVLGAGVVGVTSAYQLA |
| 601, 602 | Unknown | Probability: 0.773 AA1: 20 AA2: 21 | MKITILGAGVIGVTSAYYLA |
| 603, 604 | Unknown | Probability: 0.781 AA1: 21 AA2: 22 | MKRVIVIGSGALGLCSAYFLQ |
| 605, 606 | Unknown | | |
| 607, 608 | Unknown | | |
| 609, 610 | Unknown | | |

TABLE 2-continued

| SEQ ID NO: | Source | Signalp Cleavage Site | Predicted Signal Sequence |
|---|---|---|---|
| 611, 612 | Unknown | Probability: 0.772 AA1: 20 AA2: 21 | MKITILGAGVIGVTSAYYLA |
| 613, 614 | Unknown | Probability: 0.995 AA1: 18 AA2: 19 | MKITIIGAGIAGVSTAWA |
| 615, 616 | Unknown | | |
| 617, 618 | Unknown | | |
| 619, 620 | Unknown | | |
| 621, 622 | Unknown | Probability: 0.710 AA1: 24 AA2: 25 | MRTSKSVIVCGGGIVGLCTAYYLA |
| 623, 624 | Unknown | | |
| 625, 626 | *Flavobacterium* sp. ATCC 27551 | | |
| 627, 628 | Unknown | | |
| 629, 630 | Unknown | | |
| 631, 632 | Unknown | | |
| 633, 634 | Unknown | Probability: 0.648 AA1: 20 AA2: 21 | MKVIVLGAGVIGTTTAYYLA |
| 635, 636 | Unknown | Probability: 0.651 AA1: 20 AA2: 21 | MKVIVLGAGVIGTTTAYYLA |
| 637, 638 | Unknown | | |
| 639, 640 | Unknown | | |
| 641, 642 | Unknown | | |
| 643, 644 | Unknown | Probability: 0.993 AA1: 24 AA2: 25 | MTRARHVVVIGAGVVGSCTAQALA |
| 645, 646 | Unknown | | |
| 647, 648 | Unknown | | |
| 649, 650 | Unknown | | |
| 651, 652 | Unknown | Probability: 0.598 AA1: 21 AA2: 22 | MAREVIVLGAGIVGVSTAAHL |
| 653, 654 | Unknown | | |
| 655, 656 | Unknown | | |
| 657, 658 | Unknown | | |
| 659, 660 | Unknown | | |
| 661, 662 | Unknown | Probability: 0.944 AA1: 39 AA2: 40 | MKRSVQRRQVVLGSGAALLVGALDG CAGSIRTLQSPAPA |
| 663, 664 | Unknown | | |
| 665, 666 | Unknown | Probability: 0.910 AA1: 17 AA2: 18 | MKSVAIIGAGLAGLATA |

TABLE 2-continued

| SEQ ID NO: | Source | Signalp Cleavage Site | Predicted Signal Sequence |
|---|---|---|---|
| 667, 668 | Unknown | | |
| 669, 670 | Unknown | | |
| 671, 672 | Unknown | | |
| 673, 674 | Unknown | | |
| 675, 676 | Unknown | | |
| 677, 678 | Unknown | | |
| 679, 680 | Unknown | | |
| 681, 682 | Unknown | Probability: 0.781 AA1: 22 AA2: 23 | MRIVVIGAGLPGVTTACFLAQA |
| 683, 684 | Unknown | Probability: 0.549 AA1: 18 AA2: 19 | MNVLVVGAGVVGTSTALS |
| 685, 686 | Unknown | Probability: 0.957 AA1: 24 AA2: 25 | MNKRTPERVVVIGGGVVGATTALA |
| 687, 688 | Unknown | | |
| 689, 690 | Unknown | | |
| 691, 692 | Unknown | Probability: 0.984 AA1: 19 AA2: 20 | MKTIAVLGAGVTGITTAYA |
| 693, 694 | Unknown | | |
| 695, 696 | Unknown | | |
| 697, 698 | Unknown | | |
| 699, 700 | Unknown | | |
| 701, 702 | Unknown | Probability: 0.999 AA1: 22 AA2: 23 | MNRSVAIIGAGVSGLTCGVVFA |
| 703, 704 | Unknown | | |
| 705, 706 | Unknown | Probability: 0.935 AA1: 19 AA2: 20 | MKSAIVLGAGMVGVSTALA |
| 707, 708 | Unknown | | |
| 709, 710 | Unknown | | |
| 711, 712 | Unknown | | |
| 713, 714 | Unknown | | |
| 715, 716 | Unknown | Probability: 0.528 AA1: 18 AA2: 19 | MKVIVIGAGVVGATTALS |
| 717, 718 | Unknown | | |
| 719, 720 | Unknown | | |
| 721, 722 | Unknown | | |
| 723, 724 | Unknown | Probability: 0.857 AA1: 20 AA2: 21 | MHTIVIGAGVVGASTALSLA |
| 725, 726 | Unknown | | |

TABLE 2-continued

| SEQ ID NO: | Source | Signalp Cleavage Site | Predicted Signal Sequence |
|---|---|---|---|
| 727, 728 | Unknown | Probability: 0.785 AA1: 18 AA2: 19 | MHIVVIGAGVMGVTTAYA |
| 729, 730 | Unknown | | |
| 731, 732 | Unknown | | |
| 733, 734 | Unknown | Probability: 0.903 AA1: 18 AA2: 19 | MHVIVIGAGVVGSTTALA |
| 735, 736 | Unknown | Probability: 0.983 AA1: 21 AA2: 22 | KEFGTSISAATLALAARPAQS |
| 737, 738 | Unknown | | |
| 739, 740 | Unknown | | |
| 741, 742 | Unknown | | |
| 743, 744 | Unknown | | |
| 745, 746 | Unknown | Probability: 0.754 AA1: 23 AA2: 24 | MTHSDILIIGGGIAGMSAAFFLA |
| 747, 748 | Unknown | | |
| 749, 750 | Unknown | | |
| 751, 752 | Unknown | | |
| 753, 754 | Unknown | | |
| 755, 756 | Unknown | | |
| 757, 758 | Unknown | Probability: 0.911 AA1: 19 AA2: 20 | MQDILVLGAGMVGVSTALA |
| 759, 760 | Unknown | | |
| 761, 762 | Unknown | | |
| 763, 764 | Unknown | Probability: 0.857 AA1: 20 AA2: 21 | MHTIVIGAGVVGASTALSLA |
| 765, 766 | Unknown | | |
| 767, 768 | Unknown | Probability: 0.682 AA1: 22 AA2: 23 | MSLHVIVIGAGVVGASTVLSLA |
| 769, 770 | Unknown | | |
| 771, 772 | Unknown | | |
| 773, 774 | Unknown | | |
| 775, 776 | Unknown | Probability: 0.527 AA1: 15 AA2: 16 | MRVLVIGAGLAGLTA |
| 777, 778 | Unknown | | |
| 779, 780 | Unknown | | |
| 781, 782 | Unknown | | |
| 783, 784 | Unknown | | |

TABLE 2-continued

| SEQ ID NO: | Source | Signalp Cleavage Site Predicted Signal Sequence |
|---|---|---|
| 785, 786 | Unknown | Probability: MHTIVIGAGVVGTSTALSLA<br>0.706 AA1: 20<br>AA2: 21 |
| 787, 788 | Unknown | Probability: MHAIVIGAGVVGASTALSLA<br>0.639 AA1: 20<br>AA2: 21 |
| 789, 790 | Unknown | Probability: MKEVVVLGAGMVGTATALA<br>0.953 AA1: 19<br>AA2: 20 |
| 791, 792 | Unknown | |
| 793, 794 | Unknown | |
| 795, 796 | Unknown | |
| 797, 798 | Unknown | |
| 799, 800 | Unknown | |
| 801, 802 | Unknown | Probability: MHVIVIGAGVVGSTTALA<br>0.903 AA1: 18<br>AA2: 19 |
| 803, 804 | Unknown | Probability: MPPHVIVVGAGVVGASTALSLA<br>0.763 AA1: 22<br>AA2: 23 |
| 805, 806 | Unknown | |
| 807, 808 | Unknown | Probability: MHIVVIGAGVMGVTTAYA<br>0.785 AA1: 18<br>AA2: 19 |
| 809, 810 | Unknown | |
| 811, 812 | Unknown | |
| 813, 814 | Unknown | |
| 815, 816 | Unknown | |
| 817, 818 | Unknown | Probability: MKILVLGAGVVGTATALA<br>0.973 AA1: 18<br>AA2: 19 |
| 819, 820 | Unknown | Probability: MHVVVLGAGVVGTTTALALA<br>0.926 AA1: 20<br>AA2: 21 |
| 821, 822 | Unknown | |
| 823, 824 | Unknown | |
| 825, 826 | Unknown | |
| 827, 828 | Unknown | |
| 829, 830 | Unknown | Probability: MNKRTPERVVVIGGGVVGASTALA<br>0.973 AA1: 24<br>AA2: 25 |
| 831, 832 | Unknown | Probability: MYSETKTTRNVDCIVIGAGMAGASA<br>0.995 AA1: 33 AASLSAEA<br>AA2: 34 |
| 833, 834 | Unknown | Probability: MHVIVIGAGVVGSTTALA<br>0.903 AA1: 18<br>AA2: 19 |
| 835, 836 | Unknown | |
| 837, 838 | Unknown | |

TABLE 2-continued

| SEQ ID NO: | Source | Signalp Cleavage Site | Predicted Signal Sequence |
|---|---|---|---|
| 839, 840 | Unknown | | |
| 841, 842 | Unknown | | |
| 843, 844 | Unknown | | |
| 845, 846 | Unknown | | |
| 847, 848 | Unknown | | |
| 849, 850 | Unknown | Probability: 0.930 AA1: 18 AA2: 19 | MRVLVLGAGVVGTATALA |
| 851, 852 | Unknown | | |
| 853, 854 | Unknown | | |
| 855, 856 | Unknown | Probability: 0.553 AA1: 23 AA2: 24 | MQKDIWDFVIVGAGMAGASTAWQ |
| 857, 858 | Unknown | Probability: 0.553 AA1: 23 AA2: 24 | MQKDIWDFVIVGAGMAGASTAWQ |
| 859, 860 | Unknown | Probability: 0.553 AA1: 23 AA2: 24 | MQKDIWDFVIVGAGMAGASTAWQ |
| 861, 862 | Unknown | Probability: 0.672 AA1: 23 AA2: 24 | MAHYDAVVVGAGVVGLTTAVSLA |
| 863, 864 | Unknown | Probability: 0.544 AA1: 20 AA2: 21 | MRVLVLGSGVIGTASAYYLA |
| 865, 866 | Unknown | | |
| 867, 868 | Unknown | | |
| 869, 870 | Unknown | | |
| 871, 872 | Unknown | | |
| 873, 874 | Unknown | | |
| 875, 876 | Unknown | | |
| 877, 878 | Unknown | | |
| 879, 880 | Unknown | | |
| 881, 882 | Unknown | | |
| 883, 884 | Unknown | | |
| 885, 886 | Unknown | | |
| 887, 888 | Unknown | | |
| 889, 890 | Unknown | | |
| 891, 892 | Unknown | | |
| 893, 894 | Unknown | | |
| 895, 896 | Unknown | | |
| 897, 898 | Unknown | | |
| 899, 900 | Unknown | | |
| 901, 902 | Unknown | | |
| 903, 904 | Unknown | | |

TABLE 2-continued

| SEQ ID NO: | Source | Signalp Cleavage Site | Predicted Signal Sequence |
|---|---|---|---|
| 905, 906 | Unknown | | |
| 907, 908 | Unknown | Probability: 0.665 AA1: 18 AA2: 19 | MAADVVWLNGAVVPAAEA |
| 909, 910 | Unknown | | |
| 911, 912 | Unknown | | |
| 913, 914 | Unknown | | |
| 915, 916 | Unknown | | |
| 917, 918 | Unknown | | |
| 919, 920 | Unknown | | |
| 921, 922 | Unknown | | |
| 923, 924 | Unknown | | |
| 925, 926 | Unknown | | |
| 927, 928 | Unknown | | |
| 929, 930 | Unknown | | |
| 931, 932 | Unknown | | |
| 933, 934 | Unknown | Probability: 0.607 AA1: 30 AA2: 31 | MARVSRRFLEDSSSGATTMAFAQLAS EAKR |
| 935, 936 | Unknown | | |
| 937, 938 | Unknown | | |
| 939, 940 | Unknown | | |
| 941, 942 | Unknown | | |
| 943, 944 | Unknown | | |
| 945, 946 | Unknown | | |
| 947, 948 | Unknown | | |
| 949, 950 | Unknown | | |
| 951, 952 | *Pyrolobus fumarius* | | |
| 953, 954 | *Aquifex aeolicus* | | |
| 955, 956 | Unknown | | |
| 957, 958 | Unknown | | |
| 959, 960 | Unknown | | |

TABLE 3

| SEQ ID NO: | NR Description | NR Accession Code | NR Evalue | NR Organism | Geneseq Protein Description | Geneseq Protein Accession Code |
|---|---|---|---|---|---|---|
| 1, 2 | conserved hypothetical protein [*Aspergillus terreus* NIH2624] | 115385557 | 1.00E−125 | *Aspergillus terreus* NIH2624 | Aminotransferase/mutase/deaminase enzyme #14. | ADS78245 |
| 3, 4 | aminotransferase; class IV [*Silicibacter* sp. TM1040] | 99078145 | 1.00E−96 | *Silicibacter* sp. TM1040 | Bacterial polypeptide #19. | ADF03944 |

TABLE 3-continued

| | | | | | | |
|---|---|---|---|---|---|---|
| 5, 6 | D-amino acid aminotransferase [*Rhodopseudomonas palustris* CGA009] | 39935662 | 8.00E−77 | *Rhodopseudomonas palustris* CGA009 | Bacterial polypeptide #19. | ADF03944 |
| 7, 8 | D-alanine transaminase [*Azoarcus* sp. BH72] | 119896473 | 1.00E−92 | *Azoarcus* sp. BH72 | *P. stutzeri* 4 D-HPG AT outer forward N-term PCR primer 1. | AEM18040 |
| 9, 10 | aminotransferase; class IV [*Nitrosomonas eutropha* C91] | 114330773 | 2.00E−46 | *Nitrosomonas eutropha* C91 | Prokaryotic essential gene #34740. | ABU33175 |
| 11, 12 | D-alanine aminotransferase [*Xanthobacter autotrophicus* Py2] gi|89350945|gb|EAS16227.1|D-alanine aminotransferase [*Xanthobacter autotrophicus* Py2] | 89360213 | 5.00E−85 | *Xanthobacter autotrophicus* Py2 | Bacterial polypeptide #19. | ADF03944 |
| 13, 14 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 2.00E−99 | *Clostridium beijerincki* NCIMB 8052 | *P. stutzeri* 4 D-HPG AT outer forward N-term PCR primer 1. | AEM18031 |
| 15, 16 | d-alanine aminotransferase [*Alcanivorax borkumensis* SK2] | 110834821 | 4.00E−56 | *Alcanivorax borkumensis* SK2 | *Bacillus* D-amino acid aminotransferase. | AAY13560 |
| 17, 18 | PUTATIVE BRANCHED-CHAIN AMINO ACID AMINOTRANSFERASE (TRANSAMINASE B) (BCAT). | 3122274 | 6.00E−49 | *Methanothermobacter thermautotrophicus* | Prokaryotic essential gene #34740. | ABU21638 |
| 19, 20 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 7.00E−97 | *Clostridium beijerincki* NCIMB 8052 | *P. stutzeri* 4 D-HPG AT outer forward N-term PCR primer 1. | AEM18031 |
| 21, 22 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 1.00E−100 | *Clostridium beijerincki* NCIMB 8052 | Mutant *Bacillus sphaericus* dat protein. | ABB08244 |
| 23, 24 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 6.00E−96 | *Clostridium beijerincki* NCIMB 8052 | Mutant *Bacillus sphaericus* dat protein. | ABB08244 |
| 25, 26 | D-amino acid aminotransferase; putative [*Methylococcus capsulatus* str. Bath] | 53802655 | 3.00E−86 | *Methylococcus capsulatus* str. Bath | *Staphylococcus aureus* protein #10. | ABM71198 |
| 27, 28 | aminotransferase, class IV [*Nocardioides* sp. JS614] gi|119537255|gb|ABL81872.1| aminotransferase, class IV [*Nocardioides* sp. JS614] | 119716594 | 9.00E−33 | *Nocardioides* sp. JS614 | *Escherichia coli* aminotransferase ilvE SEQ ID NO 2. | AEK20408 |
| 29, 30 | D-amino acid aminotransferase [*Clostridium acetobutylicum*]. | 15894079 | 3.00E−81 | *Clostridium acetobutylicum* | Prokaryotic essential gene #34740. | ABU32980 |
| 31, 32 | histidinol-phosphate aminotransferase [*Methanococcus maripaludis* C7] gi|145278069|gb|EDK17867.1| histidinol-phosphate aminotransferase [*Methanococcus maripaludis* C7] | 145644535 | 1.00E−40 | *Methanococcus maripaludis* C7 | Bacterial polypeptide #10001. | ADS43070 |
| 33, 34 | D-ALANINE AMINOTRANSFERASE (D-ASPARTATE AMINOTRANSFERASE) (D-AMINO ACID AMINOTRANSFERASE) (D-AMINO ACID TRANSAMINASE) (DAAT). | 118222 | 1.00E−108 | *Bacillus* sp. YM-1 | *P. stutzeri* 4 D-HPG AT outer forward N-term PCR primer 1. | AEM18018 |
| 35, 36 | pyridoxal phosphate-dependent enzyme, putative [*Caldivirga maquilingensis* IC-167] gi|126311802|gb|EAZ64256.1| | 126353148 | 2.00E−53 | *Caldivirga maquilingensis* IC-167 | *Klebsiella pneumoniae* polypeptide seqid 7178. | ABO62434 |

TABLE 3-continued

| SEQ IDs | Description | GI | E-value | Organism | Polypeptide | Accession |
|---|---|---|---|---|---|---|
| | pyridoxal phosphate-dependent enzyme, putative [*Caldivirga maquilingensis* IC-167] | | | | | |
| 37, 38 | glutamate-1-semialdehyde 2; 1-aminomutase; putative [*Planctomyces maris* DSM 8797] | 149173540 | 1.00E−104 | *Planctomyces maris* DSM 8797 | Bacterial polypeptide #10001. | ADN26446 |
| 39, 40 | Serine--glyoxylate transaminase [*Acidiphilium cryptum* JF-5] | 148260372 | 1.00E−94 | *Acidiphilium cryptum* JF-5 | Prokaryotic essential gene #34740. | ABU21492 |
| 41, 42 | Chain A, Crystallographic Structure Of D-Amino Acid Aminotransferase Complexed With Pyridoxal-5-Phosphate. | 1127164 | 1.00E−126 | *Bacillus* sp. YM-1 | *P. stutzeri* 4 D-HPG AT outer forward N-term PCR primer 1. | AEM18037 |
| 43, 44 | glutamate-1-semialdehyde 2; 1-aminomutase; putative [*Planctomyces maris* DSM 8797] | 149173540 | 1.00E−115 | *Planctomyces maris* DSM 8797 | Bacterial polypeptide #10001. | ADN26446 |
| 45, 46 | Serine--glyoxylate transaminase [*Acidiphilium cryptum* JF-5] | 148260372 | 1.00E−111 | *Acidiphilium cryptum* JF-5 | Prokaryotic essential gene #34740. | ABU21492 |
| 47, 48 | glutamate-1-semialdehyde 2; 1-aminomutase; putative [*Planctomyces maris* DSM 8797] | 149173540 | 1.00E−103 | *Planctomyces maris* DSM 8797 | Bacterial polypeptide #10001. | ADN26446 |
| 49, 50 | aminotransferase class-III [*Roseiflexus castenholzii* DSM 13941] gi|118014341|gb|EAV28318.1| aminotransferase class-III [*Roseiflexus castenholzii* DSM 13941] | 118061613 | 1.00E−108 | *Roseiflexus castenholzii* DSM 13941 | Bacterial polypeptide #10001. | ADN26446 |
| 51, 52 | aminotransferase class-III [*Roseiflexus castenholzii* DSM 13941] gi|118014341|gb|EAV28318.1| aminotransferase class-III [*Roseiflexus castenholzii* DSM 13941] | 118061613 | 1.00E−107 | *Roseiflexus castenholzii* DSM 13941 | Bacterial polypeptide #10001. | ADN26446 |
| 53, 54 | D-alanine aminotransferase [*Lactobacillus salivarius* subsp. *salivarius* UCC118] | 90962639 | 3.00E−70 | *Lactobacillus salivarius* subsp. *salivarius* UCC118 | *Staphylococcus aureus* protein #10. | ABM71198 |
| 55, 56 | aminotransferase; class I and II [*Pseudomonas putida* F1] | 148547264 | 2.00E−66 | *Pseudomonas putida* F1 | *Pseudomonas aeruginosa* polypeptide #3. | ABO84364 |
| 57, 58 | aminotransferase; class I and II [*Pseudomonas putida* F1] | 148547264 | 5.00E−66 | *Pseudomonas putida* F1 | *Pseudomonas aeruginosa* polypeptide #3. | ABO84364 |
| 59, 60 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 61, 62 | aminotransferase; class I and II [*Pseudomonas putida* F1] | 148547264 | 2.00E−66 | *Pseudomonas putida* F1 | *Pseudomonas aeruginosa* polypeptide #3. | ABO84364 |
| 63, 64 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 65, 66 | COG0436: Aspartate/tyrosine/aromatic aminotransferase [*Pseudomonas aeruginosa* C3719] gi|126170242|gb|EAZ55753.1| aspartate transaminase [*Pseudomonas aeruginosa* C3719] | 84317581 | 6.00E−59 | *Pseudomonas aeruginosa* C3719 | *Pseudomonas aeruginosa* polypeptide #3. | ABO84364 |
| 67, 68 | COG0436: Aspartate/tyrosine/aromatic aminotransferase [*Pseudomonas aeruginosa* C3719] gi|126170242|gb|EAZ55753.1| aspartate transaminase [*Pseudomonas aeruginosa* C3719] | 84317581 | 1.00E−57 | *Pseudomonas aeruginosa* C3719 | *Pseudomonas aeruginosa* polypeptide #3. | ABO84364 |
| 69, 70 | COG0436: Aspartate/tyrosine/aromatic aminotransferase [*Pseudomonas aeruginosa* C3719] gi|126170242|gb|EAZ55753.1| aspartate transaminase [*Pseudomonas aeruginosa* C3719] | 84317581 | 2.00E−58 | *Pseudomonas aeruginosa* C3719 | *Pseudomonas aeruginosa* polypeptide #3. | ABO84364 |
| 71, 72 | aspartate aminotransferase [*Pseudomonas putida* KT2440] | 26990429 | 5.00E−68 | *Pseudomonas putida* KT2440 | *Pseudomonas aeruginosa* polypeptide #3. | ABO84364 |
| 73, 74 | aspartate aminotransferase [*Pseudomonas putida* KT2440] | 26990429 | 3.00E−68 | *Pseudomonas putida* KT2440 | *Pseudomonas aeruginosa* polypeptide #3. | ABO84364 |

TABLE 3-continued

| | | | | | |
|---|---|---|---|---|---|
| 75, 76 | D-alanine transaminase [*Oceanobacter* sp. RED65] gi\|94427424\|gb\|EAT12402.1\| D-alanine transaminase [*Oceanobacter* sp. RED65] | 94500389 | 1.00E−101 | *Oceanobacter* sp. RED65 | *L. pneumophila* protein SEQ ID NO 3367. | AEB37927 |
| 77, 78 | D-alanine transaminase [*Oceanobacter* sp. RED65] gi\|94427424\|gb\|EAT12402.1\| D-alanine transaminase [*Oceanobacter* sp. RED65] | 94500389 | 1.00E−101 | *Oceanobacter* sp. RED65 | *L. pneumophila* protein SEQ ID NO 3367. | AEB37927 |
| 79, 80 | aspartate aminotransferase [*Pseudomonas putida* KT2440] | 26990429 | 3.00E−64 | *Pseudomonas putida* KT2440 | *Pseudomonas aeruginosa* polypeptide #3. | ABO84364 |
| 81, 82 | aspartate aminotransferase [*Pseudomonas putida* KT2440] | 26990429 | 4.00E−66 | *Pseudomonas putida* KT2440 | *Pseudomonas aeruginosa* polypeptide #3. | ABO84364 |
| 83, 84 | glutamate-1-semialdehyde 2;1-aminomutase; putative [*Planctomyces maris* DSM 8797] | 149173540 | 1.00E−101 | *Planctomyces maris* DSM 8797 | Bacterial polypeptide #10001. | ADN26446 |
| 85, 86 | aminotransferase; class IV [*Alkalilimnicola ehrlichei* MLHE-1] | 114319339 | 1.00E−69 | *Alkalilimnicola ehrlichei* MLHE-1 | *L. pneumophila* protein SEQ ID NO 3367. | AEB37927 |
| 87, 88 | D-alanine transminase [*Thiobacillus denitrificans* ATCC 25259] | 74316285 | 3.00E−55 | *Thiobacillus denitrificans* ATCC 25259 | *P. stutzeri* 4 D-HPG AT outer forward N-term PCR primer 1. | AEM18040 |
| 89, 90 | aminotransferase; class I and II [*Pseudomonas putida* F1] | 148547264 | 5.00E−66 | *Pseudomonas putida* F1 | *Pseudomonas aeruginosa* polypeptide #3. | ABO84364 |
| 91, 92 | aminotransferase; class I and II [*Pseudomonas putida* F1] | 148547264 | 4.00E−65 | *Pseudomonas putida* F1 | *Pseudomonas aeruginosa* polypeptide #3. | ABO84364 |
| 93, 94 | aminotransferase; class I and II [*Pseudomonas putida* F1] | 148547264 | 4.00E−65 | *Pseudomonas putida* F1 | *Pseudomonas aeruginosa* polypeptide #3. | ABO84364 |
| 95, 96 | aminotransferase; class I and II [*Pseudomonas putida* F1] | 148547264 | 4.00E−65 | *Pseudomonas putida* F1 | *Pseudomonas aeruginosa* polypeptide #3. | ABO84364 |
| 97, 98 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 99, 100 | aspartate aminotransferase [*Pseudomonas putida* KT2440] | 26990429 | 1.00E−66 | *Pseudomonas putida* KT2440 | *Pseudomonas aeruginosa* polypeptide #3. | ABO84364 |
| 101, 102 | aspartate aminotransferase [*Pseudomonas putida* KT2440] | 26990429 | 7.00E−68 | *Pseudomonas putida* KT2440 | *Pseudomonas aeruginosa* polypeptide #3. | ABO84364 |
| 103, 104 | aspartate aminotransferase [*Pseudomonas putida* KT2440] | 26990429 | 5.00E−66 | *Pseudomonas putida* KT2440 | *Pseudomonas aeruginosa* polypeptide #3. | ABO84364 |
| 105, 106 | aspartate aminotransferase [*Pseudomonas putida* KT2440] | 26990429 | 2.00E−66 | *Pseudomonas putida* KT2440 | *Pseudomonas aeruginosa* polypeptide #3. | ABO84364 |
| 107, 108 | aminotransferase; class I and II [*Pseudomonas putida* F1] | 148547264 | 7.00E−65 | *Pseudomonas putida* F1 | *Pseudomonas aeruginosa* polypeptide #3. | ABO84364 |
| 109, 110 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 111, 112 | aminotransferase; class I and II [*Pseudomonas putida* F1] | 148547264 | 3.00E−66 | *Pseudomonas putida* F1 | *Pseudomonas aeruginosa* polypeptide #3. | ABO84364 |
| 113, 114 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 115, 116 | aspartate aminotransferase [*Pseudomonas putida* KT2440] | 26990429 | 1.00E−65 | *Pseudomonas putida* KT2440 | *Pseudomonas aeruginosa* polypeptide #3. | ABO84364 |
| 117, 118 | aminotransferase; class I and II [*Pseudomonas putida* F1] | 148547264 | 4.00E−65 | *Pseudomonas putida* F1 | *Pseudomonas aeruginosa* polypeptide #3. | ABO84364 |
| 119, 120 | aminotransferase; class I and II [*Pseudomonas putida* F1] | 148547264 | 1.00E−65 | *Pseudomonas putida* F1 | *Pseudomonas aeruginosa* polypeptide #3. | ABO84364 |
| 121, 122 | aminotransferase; class I and II [*Pseudomonas putida* F1] | 148547264 | 4.00E−65 | *Pseudomonas putida* F1 | *Pseudomonas aeruginosa* polypeptide #3. | ABO84364 |
| 123, 124 | aspartate aminotransferase [*Pseudomonas putida* KT2440] | 26990429 | 8.00E−66 | *Pseudomonas putida* KT2440 | *Pseudomonas aeruginosa* polypeptide #3. | ABO84364 |
| 125, 126 | D-alanine aminotransferase [*Streptomyces avermitilis* MA-4680] | 29833346 | 4.00E−77 | *Streptomyces avermitilis* MA-4680 | *Escherichia coli* aminotransferase ilvE SEQ ID NO 2. | AEK20408 |
| 127, 128 | glutamate-1-semialdehyde 2;1-aminomutase; putative [*Planctomyces maris* DSM 8797] | 149173540 | 1.00E−143 | *Planctomyces maris* DSM 8797 | Bacterial polypeptide #10001. | ADN26446 |
| 129, 130 | D-alanine aminotransferase [*Rhodobacter sphaeroides* 2.4.1] | 77465457 | 1.00E−87 | *Rhodobacter sphaeroides* 2.4.1 | Bacterial polypeptide #19. | ADF03944 |
| 131, 132 | D-Amino Acid Aminotransferase [*Bacillus* sp. B14905] gi\|126591833\|gb\|EAZ85916.1\| D-Amino Acid Aminotransferase [*Bacillus* sp. B14905] | 126651304 | 1.00E−158 | *Bacillus* sp. B14905 | *P. taetrolens* aldolase 2. | ADW43694 |
| 133, 134 | aminotransferase class-IV [*Azoarcus* sp. EbN1] | 56477154 | 4.00E−67 | *Azoarcus* sp. EbN1 | Prokaryotic essential gene #34740. | ABU33175 |
| 135, 136 | D-alanine aminotransferase [*Rhodobacter sphaeroides* 2.4.1] | 77465457 | 1.00E−87 | *Rhodobacter sphaeroides* 2.4.1 | Bacterial polypeptide #19. | ADF03944 |

TABLE 3-continued

| | | | | | |
|---|---|---|---|---|---|
| 137, 138 | glutamate-1-semialdehyde 2;1-aminomutase; putative [*Planctomyces maris* DSM 8797] | 149173540 | 1.00E−111 | *Planctomyces maris* DSM 8797 | Bacterial polypeptide #10001. | ADN26446 |
| 139, 140 | glutamate-1-semialdehyde 2;1-aminomutase; putative [*Planctomyces maris* DSM 8797] | 149173540 | 1.00E−108 | *Planctomyces maris* DSM 8797 | Bacterial polypeptide #10001. | ADN26446 |
| 141, 142 | Putative D-alanine aminotransferase [*Bradyrhizobium* sp.*ORS278*] | 146342961 | 2.00E−71 | *Bradyrhizobium* sp. ORS278 | Bacterial polypeptide #19. | ADF03944 |
| 143, 144 | Aminotransferase, class IV [*Robiginitalea biformata* HTCC2501] gi|88783620|gb|EAR14791.1| Aminotransferase, class IV [*Robiginitalea biformata* HTCC2501] | 88806011 | 1.00E−101 | *Robiginitalea biformata* HTCC2501 | *Bacillus* D-amino acid aminotransferase. | AAY13560 |
| 145, 146 | glutamate-1-semialdehyde 2;1-aminomutase; putative [*Planctomyces maris* DSM 8797] | 149173540 | 1.00E−114 | *Planctomyces maris* DSM 8797 | Bacterial polypeptide #10001. | ADN26446 |
| 147, 148 | aminotransferase class-III [*Roseiflexus castenholzii* DSM 13941] gi|118014341|gb|EAV28318.1| aminotransferase class-III [*Roseiflexus castenholzii* DSM 13941] | 118061613 | 1.00E−104 | *Roseiflexus castenholzii* DSM 13941 | Bacterial polypeptide #10001. | ADN26446 |
| 149, 150 | glutamate-1-semialdehyde 2;1-aminomutase; putative [*Planctomyces maris* DSM 8797] | 149173540 | 1.00E−114 | *Planctomyces maris* DSM 8797 | Bacterial polypeptide #10001. | ADN26446 |
| 151, 152 | D-alanine aminotransferase [*Bacillus licheniformis* ATCC 14580] | 52079452 | 1.00E−56 | *Bacillus licheniformis* ATCC 14580 | *P. stutzeri* 4 D-HPG AT outer forward N-term PCR primer 1. | AEM18039 |
| 153, 154 | glutamate-1-semialdehyde 2;1-aminomutase; putative [*Planctomyces maris* DSM 8797] | 149173540 | 1.00E−97 | *Planctomyces maris* DSM 8797 | Bacterial polypeptide #10001. | ADN26446 |
| 155, 156 | aminotransferase class-III [*Chloroflexus aggregans* DSM 9485] gi|117997930|gb|EAV12112.1| aminotransferase class-III [*Chloroflexus aggregans* DSM 9485] | 118045454 | 1.00E−107 | *Chloroflexus aggregans* DSM 9485 | Bacterial polypeptide #10001. | ADN26446 |
| 157, 158 | aminotransferase, class IV [*Rhodobacterales bacterium* HTCC2150] gi|126706255|gb|EBA05345.1| aminotransferase, class IV [*Rhodobacterales bacterium* HTCC2150] | 126725091 | 2.00E−78 | *Rhodobacterales bacterium* HTCC2150 | Bacterial polypeptide #19. | ADF03944 |
| 159, 160 | hypothetical protein ALPR1_18298 [*Algoriphagus* sp. PR1] gi|126576766|gb|EAZ81014.1| hypothetical protein ALPR1_18298 [*Algoriphagus* sp. PR1] | 126646718 | 6.00E−43 | *Algoriphagus* sp. PR1 | Prokaryotic essential gene #34740. | ABU18963 |
| 161, 162 | D-amino acid aminotransferase, putative [*Roseobacter* sp. MED193] gi|85823158|gb|EAQ43371.1| D-amino acid aminotransferase, putative [*Roseobacter* sp. MED193] | 86140221 | 1.00E−139 | *Roseobacter* sp. MED193 | Bacterial polypeptide #19. | ADF03944 |
| 163, 164 | glutamate-1-semialdehyde 2;1-aminomutase; putative [*Planctomyces maris* DSM 8797] | 149173540 | 1.00E−105 | *Planctomyces maris* DSM 8797 | Bacterial polypeptide #10001. | ADN26446 |
| 165, 166 | aminotransferase class-III [*Roseiflexus* sp. RS-1] | 148656729 | 1.00E−105 | *Roseiflexus* sp. RS-1 | Bacterial polypeptide #10001. | ADN26446 |
| 167, 168 | D-amino acid aminotransferase [*Clostridium beijerincki* NCIMB 8052] gi|82726488|gb|EAP61226.1|D-amino acid aminotransferase | 82745661 | 8.00E−96 | *Clostridium beijerincki* NCIMB 8052 | *P. stutzeri* 4 D-HPG AT outer forward N-term PCR primer 1. | AEM18031 |

TABLE 3-continued

| | | | | | | |
|---|---|---|---|---|---|---|
| | [*Clostridium beijerincki* NCIMB 8052] | | | | | |
| 169, 170 | putative amino acid aminotransferase [*Mycobacterium vanbaalenii* PYR-1] gi\|119958874\|gb\|ABM15879.1\| putative amino acid aminotransferase [*Mycobacterium vanbaalenii* PYR-1] | 120406056 | 1.00E−144 | *Mycobacterium vanbaalenii* PYR-1 | Prokaryotic essential gene #34740. | ABU33708 |
| 171, 172 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 3.00E−99 | *Clostridium beijerincki* NCIMB 8052 | *P. stutzeri* 4 D-HPG AT outer forward N-term PCR primer 1. | AEM18031 |
| 173, 174 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 1.00E−98 | *Clostridium beijerincki* NCIMB 8052 | Mutant *Bacillus sphaericus* dat protein. | ABB08244 |
| 175, 176 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 7.00E−98 | *Clostridium beijerincki* NCIMB 8052 | Mutant *Bacillus sphaericus* dat protein. | ABB08244 |
| 177, 178 | aminotransferase class-III [*Roseiflexus castenholzii* DSM 13941] gi\|118014341\|gb\|EAV28318.1\| aminotransferase class-III [*Roseiflexus castenholzii* DSM 13941] | 118061613 | 1.00E−110 | *Roseiflexus castenholzii* DSM 13941 | Bacterial polypeptide #10001. | ADN26446 |
| 179, 180 | D-amino acid aminotransferase [*Bacillus coagulans* 36D1] gi\|124497181\|gb\|EAY44748.1\| D-amino acid aminotransferase [*Bacillus coagulans* 36D1] | 124520974 | 4.00E−54 | *Bacillus coagulans* 36D1 | *Staphylococcus aureus* protein #10. | ABM71198 |
| 181, 182 | branched-chain amino acid aminotransferase [*Thermosynechococcus elongatus* BP-1]. | 22299586 | 7.00E−53 | *Thermosynechococcus elongatus* BP-1 | Prokaryotic essential gene #34740. | ABU18055 |
| 183, 184 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 185, 186 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 187, 188 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 1.00E−96 | *Clostridium beijerincki* NCIMB 8052 | *P. stutzeri* 4 D-HPG AT outer forward N-term PCR primer 1. | AEM18031 |
| 189, 190 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 9.00E−98 | *Clostridium beijerincki* NCIMB 8052 | Mutant *Bacillus sphaericus* dat protein. | ABB08244 |
| 191, 192 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 1.00E−96 | *Clostridium beijerincki* NCIMB 8052 | *P. stutzeri* 4 D-HPG AT outer forward N-term PCR primer 1. | AEM18031 |
| 193, 194 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 1.00E−96 | *Clostridium beijerincki* NCIMB 8052 | *P. stutzeri* 4 D-HPG AT outer forward N-term PCR primer 1. | AEM18031 |

TABLE 3-continued

| | | | | | | |
|---|---|---|---|---|---|---|
| 195, 196 | putative D-alanine aminotransferase [*Bacillus* sp. SG-1] | 149182609 | 1.00E−59 | *Bacillus* sp. SG-1 | *Bacillus* D-amino acid aminotransferase. | AAY13560 |
| 197, 198 | putative D-alanine aminotransferase [*Bacillus* sp. SG-1] | 149182609 | 3.00E−57 | *Bacillus* sp. SG-1 | *P. stutzeri* 4 D-HPG AT outer forward N-term PCR primer 1. | AEM18039 |
| 199, 200 | putative D-alanine aminotransferase [*Bacillus* sp. SG-1] | 149182609 | 5.00E−59 | *Bacillus* sp. SG-1 | *Bacillus* D-amino acid aminotransferase. | AAY13560 |
| 201, 202 | D-alanine aminotransferase [*Symbiobacterium thermophilum* IAM 14863] | 51892468 | 6.00E−57 | *Symbiobacterium thermophilum* IAM 14863 | *Bacillus* D-amino acid aminotransferase. | AAY13560 |
| 203, 204 | PUTATIVE BRANCHED-CHAIN AMINO ACID AMINOTRANSFERASE (TRANSAMINASE B) (BCAT). | 3122274 | 2.00E−46 | *Methanothermobacter thermautotrophicus* | Prokaryotic essential gene #34740. | ABU23351 |
| 205, 206 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 207, 208 | D-alanine aminotransferase [*Oceanobacillus iheyensis*]. | 23098538 | 7.00E−51 | *Oceanobacillus iheyensis* | *P. stutzeri* 4 D-HPG AT outer forward N-term PCR primer 1. | AEM18040 |
| 209, 210 | aminotransferase class-III [*Roseiflexus castenholzii* DSM 13941] gi\|118014341\|gb\|EAV28318-1\| aminotransferase class-III [*Roseiflexus castenholzii* DSM 13941] | 118061613 | 1.00E−105 | *Roseiflexus castenholzii* DSM 13941 | Bacterial polypeptide #10001. | ADN26446 |
| 211, 212 | hypothetical protein CdifQ_04002916 [*Clostridium difficile* QCD-32g58] | 145952948 | 6.00E−42 | *Clostridium difficile* QCD-32g58 | Bacterial polypeptide #10001. | ADS43070 |
| 213, 214 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 3.00E−95 | *Clostridium beijerincki* NCIMB 8052 | *P. stutzeri* 4 D-HPG AT outer forward N-term PCR primer 1. | AEM18018 |
| 215, 216 | aminotransferase class-III [*Roseiflexus castenholzii* DSM 13941] gi\|118014341\|gb\|EAV28318.1\| aminotransferase class-III [*Roseiflexus castenholzii* DSM 13941] | 118061613 | 1.00E−116 | *Roseiflexus castenholzii* DSM 13941 | Bacterial polypeptide #10001. | ADN26446 |
| 217, 218 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 219, 220 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 3.00E−98 | *Clostridium beijerincki* NCIMB 8052 | Mutant *Bacillus sphaericus* dat protein. | ABB08244 |
| 221, 222 | D-alanine aminotransferase [*Symbiobacterium thermophilum* IAM 14863] | 51892468 | 1.00E−57 | *Symbiobacterium thermophilum* IAM 14863 | *Bacillus* D-amino acid aminotransferase. | AAY13560 |
| 223, 224 | D-alanine aminotransferase [*Oceanobacillus iheyensis*]. | 23098538 | 3.00E−97 | *Oceanobacillus iheyensis* | Heat resistant D-amino acid aminotransferase encoding DNA. | ABB06297 |
| 225, 226 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 7.00E−97 | *Clostridium beijerincki* NCIMB 8052 | Mutant *Bacillus sphaericus* dat protein. | ABB08244 |
| 227, 228 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 4.00E−98 | *Clostridium beijerincki* NCIMB 8052 | *P. stutzeri* 4 D-HPG AT outer forward N-term PCR primer 1. | AEM18031 |
| 229, 230 | D-amino acid aminotransferase [*Clostridium beijerincki* NCIMB 8052] gi\|82726488\|gb\|EAP61226.1\|D-amino acid aminotransferase [*Clostridium beijerincki* NCIMB 8052] | 82745661 | 3.00E−94 | *Clostridium beijerincki* NCIMB 8052 | Mutant *Bacillus sphaericus* dat protein. | ABB08244 |

TABLE 3-continued

| | | | | | |
|---|---|---|---|---|---|
| 231, 232 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 2.00E−97 | *Clostridium beijerincki* NCIMB 8052 | *P. stutzeri* 4 D-HPG AT outer forward N-term PCR primer 1. | AEM18031 |
| 233, 234 | hypothetical protein ALPR1_18298 [*Algoriphagus* sp. PR1] gi|126576766|gb|EAZ81014.1| hypothetical protein ALPR1_18298 [*Algoriphagus* sp. PR1] | 126646718 | 2.00E−43 | *Algoriphagus* sp. PR1 | *B. licheniformis* butyryl-CoA dehydrogenase/acyl-CoA dehydrogenase pro. 1. | AEJ13860 |
| 235, 236 | branched-chain amino acid aminotransferase (ilvE) [*Pyrobaculum aerophilum*]. | 18313971 | 1.00E−43 | *Pyrobaculum aerophilum* | Aquifex aspartate aminotransferase B DNA. | ABU57358 |
| 237, 238 | d-alanine aminotransferase [*Alcanivorax borkumensis* SK2] | 110834821 | 1.00E−55 | *Alcanivorax borkumensis* SK2 | Bacillus D-amino acid aminotransferase. | AAY13560 |
| 239, 240 | d-alanine aminotransferase [*Alcanivorax borkumensis* SK2] | 110834821 | 2.00E−54 | *Alcanivorax borkumensis* SK2 | Bacillus D-amino acid aminotransferase. | AAY13560 |
| 241, 242 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 243, 244 | D-alanine aminotransferase [*Oceanobacillus iheyensis*]. | 23098538 | 2.00E−53 | *Oceanobacillus iheyensis* | *P. stutzeri* 4 D-HPG AT outer forward N-term PCR primer 1. | AEM18040 |
| 245, 246 | aromatic amino acid aminotransferase [*Pseudomonas entomophila* L48] | 104781758 | 1.00E−153 | *Pseudomonas entomophila* L48 | *Klebsiella pneumoniae* polypeptide seqid 7178. | ABO61955 |
| 247, 248 | D-amino acid aminotransferase [*Clostridium beijerincki* NCIMB 8052] gi|82726488|gb|EAP61226.1|D-amino acid aminotransferase [*Clostridium beijerincki* NCIMB 8052] | 82745661 | 6.00E−99 | *Clostridium beijerincki* NCIMB 8052 | Mutant *Bacillus sphaericus* dat protein. | ABB08244 |
| 249, 250 | putative aminotransferase [*Thermobifida fusca* YX] | 72162511 | 8.00E−29 | *Thermobifida fusca* YX | *Escherichia coli* aminotransferase ilvE SEQ ID NO 2. | AEK20408 |
| 251, 252 | D-amino acid dehydrogenase [*Methylobacillus flagellatus* KT] | 91775144 | 6.00E−17 | *Methylobacillus flagellatus* KT | *Enterobacter cloacae* protein amino acid sequence - SEQ ID 5666. | AEH60497 |
| 253, 254 | D-amino acid dehydrogenase; small chain [*Rhodopirellula baltica* SH 1] | 32473614 | 1.00E−152 | *Rhodopirellula baltica* SH 1 | *N. gonorrhoeae* nucleotide sequence SEQ ID 4691. | ABP80542 |
| 255, 256 | D-amino-acid dehydrogenase [*Burkholderia xenovorans* LB400] | 91779297 | 0 | *Burkholderia xenovorans* LB400 | Glyphosate oxidoreductase gene downstream flanking region. | AAR22262 |
| 257, 258 | putative D-amino-acid dehydrogenase (DadA-like) [*Bradyrhizobium* sp. ORS278] | 146341475 | 1.00E−174 | *Bradyrhizobium* sp. ORS278 | Glyphosate oxidoreductase gene downstream flanking region. | AAR22262 |
| 259, 260 | D-amino acid dehydrogenase small subunit [*Bradyrhizobium japonicum* USDA 110] | 27377333 | 1.00E−163 | *Bradyrhizobium japonicum* USDA 110 | *P. aeruginosa* virulence gene, VIR14, protein. | ADQ03060 |
| 261, 262 | D-amino-acid dehydrogenase [*Sinorhizobium medicae* WSM419] gi|113726415|gb|EAU07507.1| D-amino-acid dehydrogenase [*Sinorhizobium medicae* WSM419] | 113871743 | 1.00E−166 | *Sinorhizobium medicae* WSM419 | Glyphosate oxidoreductase gene downstream flanking region. | AAR22262 |
| 263, 264 | D-amino acid dehydrogenase, small subunit [*Mesorhizobium loti*]. | 13473406 | 1.00E−164 | *Mesorhizobium loti* | *P. aeruginosa* virulence gene, VIR14, protein. | ADQ03060 |
| 265, 266 | Methylenetetrahydrofolate dehydrogenase (NADP+) [*Chromohalobacter salexigens* DSM 3043] | 92114170 | 1.00E−112 | *Chromohalobacter salexigens* DSM 3043 | Bacterial polypeptide #10001. | ADS25020 |
| 267, 268 | D-amino acid dehydrogenase small subunit [*Bordetella parapertussis* 12822] | 33596520 | 1.00E−172 | *Bordetella parapertussis* 12822 | *P. aeruginosa* virulence gene, VIR14, protein. | ADQ03060 |
| 269, 270 | D-amino acid dehydrogenase; small subunit [*Pseudomonas stutzeri* A1501] | 146280878 | 0 | *Pseudomonas stutzeri* A1501 | *P. aeruginosa* virulence gene, VIR14, protein. | ADQ03060 |
| 271, 272 | D-amino-acid dehydrogenase [*Ralstonia eutropha* JMP134] | 73541345 | 1.00E−144 | *Ralstonia eutropha* JMP134 | Glyphosate oxidoreductase gene downstream flanking region. | AAR22262 |
| 273, 274 | D-amino acid dehydrogenase subunit [*Xanthomonas axonopodis* pv. citri str. 306]. | 21243478 | 1.00E−106 | *Xanthomonas axonopodis* pv. citri str. 306 | *P. aeruginosa* virulence gene, VIR14, protein. | ADQ03060 |
| 275, 276 | D-amino-acid dehydrogenase [*Nitrobacter hamburgensis* X14] | 92118208 | 1.00E−174 | *Nitrobacter hamburgensis* X14 | Glyphosate oxidoreductase gene downstream flanking region. | AAR22262 |
| 277, | D-amino-acid dehydrogenase | 92118208 | 1.00E−170 | *Nitrobacter* | Glyphosate oxidoreductase gene | AAR22262 |

TABLE 3-continued

| | | | | | | |
|---|---|---|---|---|---|---|
| 278 | [*Nitrobacter hamburgensis* X14] | | | *hamburgensis* X14 | downstream flanking region. | |
| 279, 280 | D-amino-acid dehydrogenase [*Rhodopseudomonas palustris* HaA2] | 86750758 | 1.00E−116 | *Rhodopseudomonas palustris* HaA2 | Glyphosate oxidoreductase gene downstream flanking region. | AAR22262 |
| 281, 282 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E−151 | *Ralstonia pickettii* 12J | Glyphosate oxidoreductase gene downstream flanking region. | AAR22262 |
| 283, 284 | D-amino acid dehydrogenase small subunit [*Bradyrhizobium japonicum* USDA 110] | 27377333 | 1.00E−158 | *Bradyrhizobium japonicum* USDA 110 | *P. aeruginosa* virulence gene, VIR14, protein. | ADQ03060 |
| 285, 286 | D-amino acid dehydrogenase [*Flavobacterium* sp. MED217] | 86141912 | 2.00E−87 | *Flavobacterium* sp. MED217 | *M. catarrhalis* protein #1. | ADL05210 |
| 287, 288 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | 87309573 | 1.00E−128 | *Blastopirellula marina* DSM 3645 | Glyphosate oxidoreductase gene downstream flanking region. | AAR22262 |
| 289, 290 | possible D-amino-acid dehydrogenase [*Rhodopseudomonas palustris* CGA009] | 39936835 | 1.00E−120 | *Rhodopseudomonas palustris* CGA009 | Glyphosate oxidoreductase gene downstream flanking region. | AAR22262 |
| 291, 292 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | 87309573 | 1.00E−136 | *Blastopirellula marina* DSM 3645 | *P. aeruginosa* virulence gene, VIR14, protein. | ADQ03060 |
| 293, 294 | D-amino acid dehydrogenase; small subunit family protein [*Pseudomonas entomophila* L48] | 104781752 | 0 | *Pseudomonas entomophila* L48 | Glyphosate oxidoreductase gene downstream flanking region. | AAR22262 |
| 295, 296 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 4.00E−86 | *Microscilla marina* ATCC 23134 | Glyphosate oxidoreductase gene downstream flanking region. | AAR22262 |
| 297, 298 | D-amino acid dehydrogenase; small subunit [*Pseudomonas stutzeri* A1501] | 146284421 | 1.00E−177 | *Pseudomonas stutzeri* A1501 | *Acinetobacter baumannii* protein #19. | ADA36279 |
| 299, 300 | D-amino acid dehydrogenase; small subunit [*Pseudomonas stutzeri* A1501] | 146284421 | 1.00E−176 | *Pseudomonas stutzeri* A1501 | *Acinetobacter baumannii* protein #19. | ADA36279 |
| 301, 302 | putative d-amino acid dehydrogenase small subunit [*Rhizobium leguminosarum* bv. *viciae* 3841] | 116250556 | 1.00E−168 | *Rhizobium leguminosarum* bv. *viciae* 3841 | Glyphosate oxidoreductase gene downstream flanking region. | AAR22262 |
| 303, 304 | D-amino-acid dehydrogenase [*Sphingomonas wittichii* RW1] | 148553731 | 4.00E−90 | *Sphingomonas wittichii* RW1 | *P. aeruginosa* virulence gene, VIR14, protein. | ADQ03060 |
| 305, 306 | D-amino acid dehydrogenase small subunit [*Escherichia coli* CFT073] | 26247503 | 0 | *Escherichia coli* CFT073 | *Enterobacter cloacae* protein amino acid sequence - SEQ ID 5666. | AEH60497 |
| 307, 308 | putative d-amino acid dehydrogenase small subunit [*Rhizobium leguminosarum* bv. *viciae* 3841] | 116250556 | 1.00E−129 | *Rhizobium leguminosarum* bv. *viciae* 3841 | Glyphosate oxidoreductase gene downstream flanking region. | AAR22262 |
| 309, 310 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 5.00E−98 | *Microscilla marina* ATCC 23134 | *H. pylori* GHPO 1099 gene. | AAW98270 |
| 311, 312 | D-amino acid dehydrogenase small subunit [*Bradyrhizobium japonicum* USDA 110] | 27377333 | 0 | *Bradyrhizobium japonicum* USDA 110 | *P. aeruginosa* virulence gene, VIR14, protein. | ADQ03060 |
| 313, 314 | D-amino-acid dehydrogenase [*Rhodopseudomonas palustris* HaA2] | 86750758 | 1.00E−119 | *Rhodopseudomonas palustris* HaA2 | Glyphosate oxidoreductase gene downstream flanking region. | AAR22262 |

TABLE 3-continued

| | | | | | | |
|---|---|---|---|---|---|---|
| 315, 316 | D-amino-acid dehydrogenase [*Ralstonia eutropha* JMP134] | 73541345 | 1.00E−145 | *Ralstonia eutropha* JMP134 | Glyphosate oxidoreductase gene downstream flanking region. | AAR22262 |
| 317, 318 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 5.00E−96 | *Flavobacteriales bacterium* HTCC2170 | *M. catarrhalis* protein #1. | ADL05210 |
| 319, 320 | Enoyl-CoA hydratase/isomerase:3-hydroxyacyl-CoA dehydrogenase, 3-hydroxyacyl-CoA dehydrogenase, NAD-binding protein [*Rhodobacterales bacterium* HTCC2150] gi|126703311|gb|EBA02409.1| Enoyl-CoA hydratase/isomerase:3-hydroxyacyl-CoA dehydrogenase, 3-hydroxyac | 126727316 | 2.00E−96 | *Rhodobacterales bacterium* HTCC2150 | Bacterial polypeptide #10001. | ADN25932 |
| 321, 322 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E−170 | *Ralstonia pickettii* 12J | Glyphosate oxidoreductase gene downstream flanking region. | AAR22262 |
| 323, 324 | D-amino-acid dehydrogenase [*Pseudomonas putida* GB-1] gi|126320385|gb|EAZ71237.1| D-amino-acid dehydrogenase [*Pseudomonas putida* GB-1] | 126355875 | 0 | *Pseudomonas putida* GB-1 | Glyphosate oxidoreductase gene downstream flanking region. | AAR22262 |
| 325, 326 | D-amino-acid dehydrogenase [*Pseudomonas putida* GB-1] gi|126319114|gb|EAZ69967-1| D-amino-acid dehydrogenase [*Pseudomonas putida* GB-1] | 126356306 | 0 | *Pseudomonas putida* GB-1 | *P. aeruginosa* virulence gene, VIR14, protein. | ADQ03060 |
| 327, 328 | D-amino acid dehydrogenase subunit [*Xanthomonas axonopodis* pv. *citri* str. 306]. | 21243478 | 1.00E−112 | *Xanthomonas axonopodis* pv. *citri* str. 306 | *P. aeruginosa* virulence gene, VIR14, protein. | ADQ03060 |
| 329, 330 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 4.00E−95 | *Flavobacteriales bacterium* HTCC2170 | *H. pylori* GHPO 1099 gene. | AAW98270 |
| 331, 332 | D-amino acid dehydrogenase small subunit [*Bradyrhizobium japonicum* USDA 110] | 27377333 | 0 | *Bradyrhizobium japonicum* USDA 110 | *P. aeruginosa* virulence gene, VIR14, protein. | ADQ03060 |
| 333, 334 | Enoyl-CoA hydratase/isomerase:3-hydroxyacyl-CoA dehydrogenase, 3-hydroxyacyl-CoA dehydrogenase, NAD-binding protein [*Rhodobacterales bacterium* HTCC2150] gi|126703311|gb|EBA02409.1| Enoyl-CoA hydratase/isomerase:3-hydroxyacyl-CoA dehydrogenase, 3-hydroxyac | 126727316 | 2.00E−96 | *Rhodobacterales bacterium* HTCC2150 | Bacterial polypeptide #10001. | ADN25932 |
| 335, 336 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E−170 | *Ralstonia pickettii* 12J | Glyphosate oxidoreductase gene downstream flanking region. | AAR22262 |
| 337, 338 | D-amino-acid dehydrogenase [*Rhodopseudomonas palustris* HaA2] | 86750758 | 1.00E−114 | *Rhodopseudomonas palustris* HaA2 | Glyphosate oxidoreductase gene downstream flanking region. | AAR22262 |
| 339, 340 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 1.00E−100 | *Microscilla marina* ATCC 23134 | *M. catarrhalis* protein #1. | ADL05210 |

TABLE 3-continued

| | | | | | | |
|---|---|---|---|---|---|---|
| 341, 342 | D-amino-acid dehydrogenase [*Ralstonia pickettii* 12J] gi\|121302471\|gb\|EAX43440.1\| D-amino-acid dehydrogenase [*Ralstonia pickettii* 12J] | 121530396 | 1.00E−170 | *Ralstonia pickettii* 12J | Glyphosate oxidoreductase gene downstream flanking region. | AAR22262 |
| 343, 344 | short-chain dehydrogenase/reductase SDR [*Novosphingobium aromaticivorans* DSM 12444] | 146275754 | 2.00E−51 | *Novosphingobium aromaticivorans* DSM 12444 | Bacterial polypeptide #10001. | ADS24609 |
| 345, 346 | D-amino-acid dehydrogenase [*Maricaulis maris* MCS10] gi\|114341114\|gb\|ABI66394.1\| D-amino-acid dehydrogenase [*Maricaulis maris* MCS10] | 114570652 | 2.00E−91 | *Maricaulis maris* MCS10 | *P. aeruginosa* virulence gene, VIR14, protein. | ADQ03060 |
| 347, 348 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E−152 | *Sinorhizobium medicae* WSM419 | Glyphosate oxidoreductase gene downstream flanking region. | AAR22262 |
| 349, 350 | D-amino-acid dehydrogenase [*Rhodopseudomonas palustris* HaA2] | 86750758 | 1.00E−117 | *Rhodopseudomonas palustris* HaA2 | Glyphosate oxidoreductase gene downstream flanking region. | AAR22262 |
| 351, 352 | D-amino acid dehydrogenase; small chain [*Rhodopirellula baltica* SH 1] | 32473614 | 1.00E−155 | *Rhodopirellula baltica* SH 1 | *N. gonorrhoeae* nucleotide sequence SEQ ID 4691. | ABP80542 |
| 353, 354 | D-amino acid dehydrogenase [*Flavobacteriales bacterium* HTCC2170] gi\|88708933\|gb\|EAR01167.1\| D-amino acid dehydrogenase [*Flavobacteriales bacterium* HTCC2170] | 88712395 | 1.00E−88 | *Flavobacteriales bacterium* HTCC2170 | Bacterial polypeptide #19. | ADF07894 |
| 355, 356 | aldehyde dehydrogenase family protein [*Myxococcus xanthus* DK 1622] | 108761092 | 2.00E−97 | *Myxococcus xanthus* DK 1622 | Bacterial polypeptide #10001. | ADN25785 |
| 357, 358 | D-amino acid dehydrogenase small subunit, putative [*Microscilla marina* ATCC 23134] gi\|123984082\|gb\|EAY24455.1\| D-amino acid dehydrogenase small subunit, putative [*Microscilla marina* ATCC 23134] | 124009931 | 1.00E−96 | *Microscilla marina* ATCC 23134 | *M. catarrhalis* protein #1. | ADL05210 |
| 359, 360 | D-amino-acid dehydrogenase small subunit [*Rhodococcus* sp. RHA1] | 111019145 | 1.00E−163 | *Rhodococcus* sp. RHA1 | *C glutamicum* coding sequence fragment SEQ ID NO: 1935. | AAG93079 |
| 361, 362 | D-amino-acid dehydrogenase small subunit [*Rhodococcus* sp. RHA1] | 111019145 | 1.00E−163 | *Rhodococcus* sp. RHA1 | *C glutamicum* coding sequence fragment SEQ ID NO: 1935. | AAG93079 |
| 363, 364 | D-amino-acid dehydrogenase small subunit [*Rhodococcus* sp. RHA1] | 111019145 | 1.00E−163 | *Rhodococcus* sp. RHA1 | *C glutamicum* coding sequence fragment SEQ ID NO: 1935. | AAG93079 |
| 365, 366 | D-amino acid dehydrogenase small subunit [*Bradyrhizobium japonicum* USDA 110] | 27377333 | 0 | *Bradyrhizobium japonicum* USDA 110 | *P. aeruginosa* virulence gene, VIR14, protein. | ADQ03060 |
| 367, 368 | D-amino acid dehydrogenase small subunit [*Herminiimonas arsenicoxydans*] gi\|133737889\|emb\|CAL60934.1\| D-amino acid dehydrogenase small subunit [*Herminiimonas arsenicoxydans*] | 134093986 | 0 | *Herminiimonas arsenicoxydans* | *P. aeruginosa* virulence gene, VIR14, protein. | ADQ03060 |
| 369, 370 | D-amino acid dehydrogenase small subunit, putative [*Microscilla marina* ATCC 23134] gi\|123984082\|gb\|EAY24455.1\| D-amino acid dehydrogenase small subunit, putative [*Microscilla marina* ATCC 23134] | 124009931 | 1.00E−101 | *Microscilla marina* ATCC 23134 | *H. pylori* GHPO 1099 gene. | AAW98270 |
| 371, 372 | D-amino acid dehydrogenase small subunit [*Bradyrhizobium japonicum* USDA 110] | 27377333 | 0 | *Bradyrhizobium japonicum* USDA 110 | *P. aeruginosa* virulence gene, VIR14, protein. | ADQ03060 |
| 373, 374 | D-amino-acid dehydrogenase [*Ralstonia eutropha* JMP134] | 73541345 | 1.00E−136 | *Ralstonia eutropha* JMP134 | Glyphosate oxidoreductase gene downstream flanking region. | AAR22262 |
| 375, | D-amino acid dehydrogenase | 91217360 | 3.00E−98 | *Psychroflexus torquis* | *Acinetobacter baumannii* protein | ADA33588 |

TABLE 3-continued

| | | | | | | |
|---|---|---|---|---|---|---|
| 376 | [*Psychroflexus torquis* ATCC 700755] gi|91184468|gb|EAS70851.1|D-amino acid dehydrogenase [*Psychroflexus torquis* ATCC 700755] | | | ATCC 700755 | #19. | |
| 377, 378 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 1.00E−122 | *Flavobacteriales bacterium* HTCC2170 | *M. catarrhalis* protein #1. | ADL05210 |
| 379, 380 | D-amino-acid dehydrogenase [*Maricaulis maris* MCS10] gi|114341114|gb|ABI66394.1| D-amino-acid dehydrogenase [*Maricaulis maris* MCS10] | 114570652 | 8.00E−91 | *Maricaulis maris* MCS10 | *P. aeruginosa* virulence gene, VIR14, protein. | ADQ03060 |
| 381, 382 | D-amino-acid dehydrogenase small subunit [*Rhodococcus* sp. RHA1] | 111019145 | 1.00E−163 | *Rhodococcus* sp. RHA1 | *C glutamicum* coding sequence fragment SEQ ID NO: 1935. | AAG93079 |
| 383, 384 | D-amino acid dehydrogenase, small subunit [*Mesorhizobium loti*]. | 13473406 | 0 | *Mesorhizobium loti* | *P. aeruginosa* virulence gene, VIR14, protein. | ADQ03060 |
| 385, 386 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 5.00E−99 | *Microscilla marina* ATCC 23134 | *H. pylori* GHPO 1099 gene. | AAW98270 |
| 387, 388 | D-amino acid dehydrogenase, small subunit [*Mesorhizobium loti*]. | 13474742 | 0 | *Mesorhizobium loti* | *Pseudomonas aeruginosa* polypeptide #3. | ABO75104 |
| 389, 390 | D-amino acid dehydrogenase small subunit [*Herminiimonas arsenicoxydans*] gi|133737889|emb|CAL60934.1| D-amino acid dehydrogenase small subunit [*Herminiimonas arsenicoxydans*] | 134093986 | 0 | *Herminiimonas arsenicoxydans* | *Klebsiella pneumoniae* polypeptide seqid 7178. | ABO67618 |
| 391, 392 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | 87309573 | 1.00E−139 | *Blastopirellula marina* DSM 3645 | *N. gonorrhoeae* nucleotide sequence SEQ ID 4691. | ABP80542 |
| 393, 394 | probable D-amino acid dehydrogenase small subunit [*Azoarcus* sp. BH72] | 119897258 | 1.00E−111 | *Azoarcus* sp. BH72 | *Pseudomonas aeruginosa* polypeptide #3. | ABO84309 |
| 395, 396 | D-amino-acid dehydrogenase [*Ralstonia eutropha* JMP134] | 73541345 | 0 | *Ralstonia eutropha* JMP134 | Glyphosate oxidoreductase gene downstream flanking region. | AAR22262 |
| 397, 398 | D-amino-acid dehydrogenase [*Rhodopseudomonas palustris* HaA2] | 86750758 | 1.00E−121 | *Rhodopseudomonas palustris* HaA2 | Glyphosate oxidoreductase gene downstream flanking region. | AAR22262 |
| 399, 400 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 2.00E−97 | *Microscilla marina* ATCC 23134 | *H. pylori* GHPO 1099 gene. | AAW98270 |
| 401, 402 | D-amino-acid dehydrogenase [*Maricaulis maris* MCS10] gi|114341114|gb|ABI66394.1| D-amino-acid dehydrogenase [*Maricaulis maris* MCS10] | 114570652 | 3.00E−66 | *Maricaulis maris* MCS10 | *M. catarrhalis* protein #1. | ADL05210 |
| 403, 404 | D-amino acid dehydrogenase small subunit, putative [*Microscilla marina* ATCC 23134] gi|123984082|gb|EAY24455.1| D-amino acid dehydrogenase small subunit, putative | 124009931 | 1.00E−111 | *Microscilla marina* ATCC 23134 | *H. pylori* GHPO 1099 gene. | AAW98270 |

TABLE 3-continued

| | | | | | | |
|---|---|---|---|---|---|---|
| | [*Microscilla marina* ATCC 23134] | | | | | |
| 405, 406 | D-amino acid dehydrogenase [*Robiginitalea biformata* HTCC2501] gi|88783849|gb|EAR15020.1| D-amino acid dehydrogenase [*Robiginitalea biformata* HTCC2501] | 88806240 | 2.00E−95 | *Robiginitalea biformata* HTCC2501 | Glyphosate oxidoreductase gene downstream flanking region. | AAR22262 |
| 407, 408 | D-amino acid dehydrogenase small subunit [*Bradyrhizobium japonicum* USDA 110] | 27377333 | 0 | *Bradyrhizobium japonicum* USDA 110 | *P. aeruginosa* virulence gene, VIR14, protein. | ADQ03060 |
| 409, 410 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 2.00E−98 | *Microscilla marina* ATCC 23134 | *P. aeruginosa* virulence gene, VIR14, protein. | ADQ03060 |
| 411, 412 | ketoglutarate semialdehyde dehydrogenase [*Pseudomonas entomophila* L48] | 104783034 | 1.00E−103 | *Pseudomonas entomophila* L48 | Bacterial polypeptide #10001. | ADN25785 |
| 413, 414 | D-amino acid dehydrogenase [*Rhodopseudomonas palustris* HaA2] | 86750758 | 1.00E−119 | *Rhodopseudomonas palustris* HaA2 | Glyphosate oxidoreductase gene downstream flanking region. | AAR22262 |
| 415, 416 | D-amino acid dehydrogenase [*Rhodopseudomonas palustris* HaA2] | 86750758 | 1.00E−125 | *Rhodopseudomonas palustris* HaA2 | Glyphosate oxidoreductase gene downstream flanking region. | AAR22262 |
| 417, 418 | AGR_L_3050p [*Agrobacterium tumefaciens*]. | 15891640 | 1.00E−179 | *Agrobacterium tumefaciens* | *P. aeruginosa* virulence gene, VIR14, protein. | ADQ03060 |
| 419, 420 | D-amino acid dehydrogenase [*Polaromonas* sp. JS666] | 91786059 | 0 | *Polaromonas* sp. JS666 | *Photorhabdus luminescens* protein sequence #59. | ABM69115 |
| 421, 422 | D-amino-acid dehydrogenase [*Rubrobacter xylanophilus* DSM 9941] | 108804652 | 1.00E−108 | *Rubrobacter xylanophilus* DSM 9941 | *C glutamicum* coding sequence fragment SEQ ID NO: 1935. | AAG93079 |
| 423, 424 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 4.00E−94 | *Microscilla marina* ATCC 23134 | *H. pylori* GHPO 1099 gene. | AAW98270 |
| 425, 426 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E−122 | *Ralstonia pickettii* 12J | Glyphosate oxidoreductase gene downstream flanking region. | AAR22262 |
| 427, 428 | D-amino acid dehydrogenase [*Nitrobacter hamburgensis* X14] | 92118208 | 0 | *Nitrobacter hamburgensis* X14 | Glyphosate oxidoreductase gene downstream flanking region. | AAR22262 |
| 429, 430 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 2.00E−97 | *Microscilla marina* ATCC 23134 | Glyphosate oxidoreductase gene downstream flanking region. | AAR22262 |
| 431, 432 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 1.00E−119 | *Microscilla marina* ATCC 23134 | Glyphosate oxidoreductase gene downstream flanking region. | AAR22262 |
| 433, 434 | D-amino-acid dehydrogenase [*Rhodopseudomonas palustris* HaA2] | 86750758 | 1.00E−123 | *Rhodopseudomonas palustris* HaA2 | Glyphosate oxidoreductase gene downstream flanking region. | AAR22262 |
| 435, 436 | D-amino-acid dehydrogenase [*Rhodopseudomonas palustris* HaA2] | 86750758 | 1.00E−121 | *Rhodopseudomonas palustris* HaA2 | Glyphosate oxidoreductase gene downstream flanking region. | AAR22262 |
| 437, | carbon monoxide | 56697247 | 1.00E−66 | *Silicibacter pomeroyi* | Bacterial polypeptide #10001. | ADS27598 |

TABLE 3-continued

| SEQ IDs | Description | GI # | E-value | Organism | Annotation | Accession |
|---|---|---|---|---|---|---|
| 438 | dehydrogenase G protein; putative [*Silicibacter pomeroyi* DSS-3] | | | | DSS-3 | |
| 439, 440 | carbon monoxide dehydrogenase F protein [*Silicibacter pomeroyi* DSS-3] | 56697248 | 1.00E−87 | *Silicibacter pomeroyi* DSS-3 | DNA encoding novel human diagnostic protein #20574. | ABG25235 |
| 441, 442 | carbon monoxide dehydrogenase E protein [*Silicibacter pomeroyi* DSS-3] | 56697249 | 1.00E−171 | *Silicibacter pomeroyi* DSS-3 | Human adhesion molecule protein AD6/CAA17374.1. | AAU75888 |
| 443, 444 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E−150 | *Sinorhizobium medicae* WSM419 | Glyphosate oxidoreductase gene downstream flanking region. | AAR22262 |
| 445, 446 | D-amino acid dehydrogenase [*Algoriphagus* sp. PR1] gi\|126578095\|gb\|EAZ82315.1\| D-amino acid dehydrogenase [*Algoriphagus* sp. PR1] | 126646463 | 1.00E−175 | *Algoriphagus* sp. PR1 | *H. pylori* GHPO 1099 gene. | AAW98270 |
| 447, 448 | D-amino-acid dehydrogenase [*Stenotrophomonas maltophilia* R551-3] gi\|119820020\|gb\|EAX22641.1\| D-amino-acid dehydrogenase [*Stenotrophomonas maltophilia* R551-3] | 119877440 | 0 | *Stenotrophomonas maltophilia* R551-3 | *P. aeruginosa* virulence gene, VIR14, protein. | ADQ03060 |
| 449, 450 | D-amino-acid dehydrogenase [*Ralstonia pickettii* 12J] gi\|121302471\|gb\|EAX43440.1\| D-amino-acid dehydrogenase [*Ralstonia pickettii* 12J] | 121530396 | 1.00E−104 | *Ralstonia pickettii* 12J | Glyphosate oxidoreductase gene downstream flanking region. | AAR22262 |
| 451, 452 | D-amino-acid dehydrogenase [*Ralstonia pickettii* 12J] gi\|121302471\|gb\|EAX43440.1\| D-amino-acid dehydrogenase [*Ralstonia pickettii* 12J] | 121530396 | 1.00E−143 | *Ralstonia pickettii* 12J | Glyphosate oxidoreductase gene downstream flanking region. | AAR22262 |
| 453, 454 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E−125 | *Sinorhizobium medicae* WSM419 | Glyphosate oxidoreductase gene downstream flanking region. | AAR22262 |
| 455, 456 | D-amino acid dehydrogenase small subunit, putative [*Microscilla marina* ATCC 23134] gi\|123984082\|gb\|EAY24455.1\| D-amino acid dehydrogenase small subunit, putative [*Microscilla marina* ATCC 23134] | 124009931 | 1.00E−104 | *Microscilla marina* ATCC 23134 | *H. pylori* GHPO 1099 gene. | AAW98270 |
| 457, 458 | D-amino acid dehydrogenase [*Flavobacteriales bacterium* HTCC2170] gi\|88708933\|gb\|EAR01167.1\| D-amino acid dehydrogenase [*Flavobacteriales bacterium* HTCC2170] | 88712395 | 1.00E−173 | *Flavobacteriales bacterium* HTCC2170 | *M. catarrhalis* protein #1. | ADL05210 |
| 459, 460 | D-amino acid dehydrogenase small subunit [*Marinobacter* sp. ELB17] gi\|126629543\|gb\|EBA00161.1\| D-amino acid dehydrogenase small subunit [*Marinobacter* sp. ELB17] | 126666221 | 0 | *Marinobacter* sp. ELB17 | *Acinetobacter baumannii* protein #19. | ADA36279 |
| 461, 462 | Short-chain dehydrogenase/reductase SDR [*Azotobacter vinelandii* AvOP] | 67154056 | 1.00E−109 | *Azotobacter vinelandii* AvOP | *Klebsiella pneumoniae* polypeptide seqid 7178. | ABO66363 |
| 463, 464 | D-amino acid dehydrogenase [*Psychroflexus torquis* ATCC 700755] gi\|91184468\|gb\|EAS70851.1\|D-amino acid dehydrogenase [*Psychroflexus torquis* ATCC 700755] | 91217360 | 1.00E−167 | *Psychroflexus torquis* ATCC 700755 | *H. pylori* GHPO 1099 gene. | AAW98270 |
| 465, 466 | dehydrogenase [*Geobacillus kaustophilus* HTA426] | 56420489 | 4.00E−18 | *Geobacillus kaustophilus* HTA426 | Hyperthermophile *Methanopyrus kandleri* protein #28. | ADM25691 |

TABLE 3-continued

| | | | | | | |
|---|---|---|---|---|---|---|
| 467, 468 | D-amino-acid dehydrogenase [*Ralstonia eutropha* JMP134] | 73541345 | 1.00E−133 | *Ralstonia eutropha* JMP134 | Glyphosate oxidoreductase gene downstream flanking region. | AAR22262 |
| 469, 470 | putative d-amino acid dehydrogenase small subunit [*Rhizobium leguminosarum* bv. *viciae* 3841] | 116250556 | 1.00E−166 | *Rhizobium leguminosarum* bv. *viciae* 3841 | Glyphosate oxidoreductase gene downstream flanking region. | AAR22262 |
| 471, 472 | D-amino acid dehydrogenase small subunit [*Escherichia coli* CFT073] | 26247503 | 0 | *Escherichia coli* CFT073 | *Enterobacter cloacae* protein amino acid sequence - SEQ ID 5666. | AEH60497 |
| 473, 474 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E−159 | *Sinorhizobium medicae* WSM419 | Glyphosate oxidoreductase gene downstream flanking region. | AAR22262 |
| 475, 476 | D-amino-acid dehydrogenase [*Maricaulis maris* MCS10] gi\|114341114\|gb\|ABI66394.1\| D-amino-acid dehydrogenase [*Maricaulis maris* MCS10] | 114570652 | 1.00E−155 | *Maricaulis maris* MCS10 | *P. aeruginosa* virulence gene, VIR14, protein. | ADQ03060 |
| 477, 478 | D-amino acid dehydrogenase [*Flavobacteriales bacterium* HTCC2170] gi\|88708933\|gb\|EAR01167.1\| D-amino acid dehydrogenase [*Flavobacteriales bacterium* HTCC2170] | 88712395 | 4.00E−85 | *Flavobacteriales bacterium* HTCC2170 | *P. aeruginosa* virulence gene, VIR14, protein. | ADQ03060 |
| 479, 480 | D-amino acid dehydrogenase [*Flavobacteriales bacterium* HTCC2170] gi\|88708933\|gb\|EAR01167.1\| D-amino acid dehydrogenase [*Flavobacteriales bacterium* HTCC2170] | 88712395 | 4.00E−85 | *Flavobacteriales bacterium* HTCC2170 | *P. aeruginosa* virulence gene, VIR14, protein. | ADQ03060 |
| 481, 482 | D-amino acid dehydrogenase [*Flavobacteriales bacterium* HTCC2170] gi\|88708933\|gb\|EAR01167.1\| D-amino acid dehydrogenase [*Flavobacteriales bacterium* HTCC2170] | 88712395 | 1.00E−175 | *Flavobacteriales bacterium* HTCC2170 | *M. catarrhalis* protein #1. | ADL05210 |
| 483, 484 | D-amino acid dehydrogenase small subunit [*Herminiimonas arsenicoxydans*] gi\|133737889\|emb\|CAL60934.1\| D-amino acid dehydrogenase small subunit [*Herminiimonas arsenicoxydans*] | 134093986 | 0 | *Herminiimonas arsenicoxydans* | *P. aeruginosa* virulence gene, VIR14, protein. | ADQ03060 |
| 485, 486 | D-amino acid dehydrogenase small subunit [*Bradyrhizobium japonicum* USDA 110] | 27377333 | 1.00E−167 | *Bradyrhizobium japonicum* USDA 110 | *P. aeruginosa* virulence gene, VIR14, protein. | ADQ03060 |
| 487, 488 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E−129 | *Sinorhizobium medicae* WSM419 | Glyphosate oxidoreductase gene downstream flanking region. | AAR22262 |
| 489, 490 | D-amino-acid dehydrogenase [*Rhodopseudomonas palustris* BisA53] | 115523700 | 1.00E−123 | *Rhodopseudomonas palustris* BisA53 | Glyphosate oxidoreductase gene downstream flanking region. | AAR22262 |
| 491, 492 | D-amino-acid dehydrogenase [*Maricaulis maris* MCS10] gi\|114341114\|gb\|ABI66394.1\| D-amino-acid dehydrogenase [*Maricaulis maris* MCS10] | 114570652 | 1.00E−78 | *Maricaulis maris* MCS10 | *P. aeruginosa* virulence gene, VIR14, protein. | ADQ03060 |
| 493, 494 | D-amino acid dehydrogenase small subunit, putative [*Microscilla marina* ATCC 23134] gi\|123984082\|gb\|EAY24455.1\| D-amino acid dehydrogenase small subunit, putative [*Microscilla marina* ATCC 23134] | 124009931 | 6.00E−90 | *Microscilla marina* ATCC 23134 | *C glutamicum* coding sequence fragment SEQ ID NO: 1935. | AAG93079 |
| 495, 496 | D-amino-acid dehydrogenase [*Rhodopseudomonas palustris* BisA53] | 115523700 | 1.00E−112 | *Rhodopseudomonas palustris* BisA53 | Glyphosate oxidoreductase gene downstream flanking region. | AAR22262 |

TABLE 3-continued

| | | | | | | |
|---|---|---|---|---|---|---|
| 497, 498 | D-amino-acid dehydrogenase [*Sinorhizobium medicae* WSM419] gi|113726415|gb|EAU07507.1| D-amino-acid dehydrogenase [*Sinorhizobium medicae* WSM419] | 113871743 | 1.00E−129 | *Sinorhizobium medicae* WSM419 | Glyphosate oxidoreductase gene downstream flanking region. | AAR22262 |
| 499, 500 | D-amino-acid dehydrogenase [*Rhodopseudomonas palustris* BisA53] | 115523700 | 1.00E−112 | *Rhodopseudomonas palustris* BisA53 | Glyphosate oxidoreductase gene downstream flanking region. | AAR22262 |
| 501, 502 | delta-1-pyrroline-5-carboxylate dehydrogenase [*Corynebacterium jeikeium* K411] | 68535524 | 1.00E−174 | *Corynebacterium jeikeium* K411 | *Corynebacterium glutamicum* MP protein sequence SEQ ID NO: 1148. | AAB79787 |
| 503, 504 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | 87309573 | 1.00E−129 | *Blastopirellula marina* DSM 3645 | *C glutamicum* coding sequence fragment SEQ ID NO: 1935. | AAG93079 |
| 505, 506 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | 87309573 | 1.00E−127 | *Blastopirellula marina* DSM 3645 | *P. aeruginosa* virulence gene, VIR14, protein. | ADQ03060 |
| 507, 508 | D-amino-acid dehydrogenase [*Nitrobacter hamburgensis* X14] | 92118208 | 1.00E−174 | *Nitrobacter hamburgensis* X14 | Glyphosate oxidoreductase gene downstream flanking region. | AAR22262 |
| 509, 510 | D-amino-acid dehydrogenase [*Rhodopseudomonas palustris* HaA2] | 86750758 | 1.00E−115 | *Rhodopseudomonas palustris* HaA2 | Glyphosate oxidoreductase gene downstream flanking region. | AAR22262 |
| 511, 512 | D-amino-acid dehydrogenase [*Ralstonia eutropha* JMP134] | 73541345 | 1.00E−166 | *Ralstonia eutropha* JMP134 | Glyphosate oxidoreductase gene downstream flanking region. | AAR22262 |
| 513, 514 | D-amino acid dehydrogenase small subunit [*Herminiimonas arsenicoxydans*] gi|133737889|emb|CAL60934.1| D-amino acid dehydrogenase small subunit [*Herminiimonas arsenicoxydans*] | 134093986 | 0 | *Herminiimonas arsenicoxydans* | *P. aeruginosa* virulence gene, VIR14, protein. | ADQ03060 |
| 515, 516 | D-amino acid dehydrogenase; small subunit [*Pseudomonas stutzeri* A1501] | 146284421 | 1.00E−177 | *Pseudomonas stutzeri* A1501 | *Acinetobacter baumannii* protein #19. | ADA36279 |
| 517, 518 | D-amino acid dehydrogenase [*Algoriphagus* sp. PR1] gi|126578095|gb|EAZ82315.1| D-amino acid dehydrogenase [*Algoriphagus* sp. PR1] | 126646463 | 1.00E−110 | *Algoriphagus* sp. PR1 | *Acinetobacter baumannii* protein #19. | ADA33588 |
| 519, 520 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 3.00E−98 | *Flavobacteriales bacterium* HTCC2170 | *N. gonorrhoeae* nucleotide sequence SEQ ID 4691. | ABP80542 |
| 521, 522 | D-amino acid dehydrogenase small subunit [*Rhodococcus* sp. RHA1] | 111019145 | 0 | *Rhodococcus* sp. RHA1 | *C glutamicum* coding sequence fragment SEQ ID NO: 1935. | AAG93079 |
| 523, 524 | D-amino acid dehydrogenase [*Algoriphagus* sp. PR1] gi|126578095|gb|EAZ82315.1| D-amino acid dehydrogenase [*Algoriphagus* sp. PR1] | 126646463 | 7.00E−87 | *Algoriphagus* sp. PR1 | *H. pylori* GHPO 1099 gene. | AAW98270 |
| 525, 526 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E−146 | *Ralstonia pickettii* 12J | Glyphosate oxidoreductase gene downstream flanking region. | AAR22262 |
| 527, 528 | putative d-amino acid dehydrogenase small subunit [*Rhizobium leguminosarum* bv. *viciae* 3841] | 116250556 | 0 | *Rhizobium leguminosarum* bv. *viciae* 3841 | Glyphosate oxidoreductase gene downstream flanking region. | AAR22262 |
| 529, 530 | D-amino-acid dehydrogenase [*Nitrobacter hamburgensis* X14] | 92118208 | 1.00E−116 | *Nitrobacter hamburgensis* X14 | Glyphosate oxidoreductase gene downstream flanking region. | AAR22262 |
| 531, 532 | probable D-amino acid dehydrogenase subunit [*Limnobacter* sp. MED105] | 149824671 | 1.00E−150 | *Limnobacter* sp. MED105 | *P. aeruginosa* virulence gene, VIR14, protein. | ADQ03060 |

TABLE 3-continued

| | | | | | |
|---|---|---|---|---|---|
| 533, 534 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 3.00E−88 | *Flavobacteriales bacterium* HTCC2170 | *M. catarrhalis* protein #1. | ADL05210 |
| 535, 536 | Aldehyde dehydrogenase [*Ralstonia eutropha* JMP134] | 73537548 | 1.00E−143 | *Ralstonia eutropha* JMP134 | Bacterial polypeptide #10001. | ADN25785 |
| 537, 538 | D-amino-acid dehydrogenase [*Ralstonia eutropha* JMP134] | 73541345 | 1.00E−136 | *Ralstonia eutropha* JMP134 | Glyphosate oxidoreductase gene downstream flanking region. | AAR22262 |
| 539, 540 | D-amino-acid dehydrogenase [*Burkholderia cepacia* AMMD] | 115359189 | 0 | *Burkholderia cepacia* AMMD | Glyphosate oxidoreductase gene downstream flanking region. | AAR22262 |
| 541, 542 | D-amino acid dehydrogenase subunit [*Xanthomonas axonopodis* pv. *citri* str. 306]. | 21243478 | 1.00E−139 | *Xanthomonas axonopodis* pv. *citri* str. 306 | *P. aeruginosa* virulence gene, VIR14, protein. | ADQ03060 |
| 543, 544 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 1.00E−107 | *Microscilla marina* ATCC 23134 | *H. pylori* GHPO 1099 gene. | AAW98270 |
| 545, 546 | D-amino-acid dehydrogenase [*Rhodopseudomonas palustris* HaA2] | 86750758 | 1.00E−117 | *Rhodopseudomonas palustris* HaA2 | Glyphosate oxidoreductase gene downstream flanking region. | AAR22262 |
| 547, 548 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 3.00E−86 | *Flavobacteriales bacterium* HTCC2170 | *Photorhabdus luminescens* protein sequence #59. | ABM69115 |
| 549, 550 | probable D-amino acid dehydrogenase subunit [*Limnobacter* sp. MED105] | 149824671 | 1.00E−146 | *Limnobacter* sp. MED105 | *P. aeruginosa* virulence gene, VIR14, protein. | ADQ03060 |
| 551, 552 | delta-1-pyrroline-5-carboxylate dehydrogenase [*Corynebacterium jeikeium* K411] | 68535524 | 0 | *Corynebacterium jeikeium* K411 | *Corynebacterium glutamicum* MP protein sequence SEQ ID NO: 1148. | AAB79787 |
| 553, 554 | D-amino-acid dehydrogenase [*Rhodopseudomonas palustris* BisA53] | 115523700 | 1.00E−12 | *Rhodopseudomonas palustris* BisA53 | Glyphosate oxidoreductase gene downstream flanking region. | AAR22262 |
| 555, 556 | D-amino-acid dehydrogenase [*Nitrobacter hamburgensis* X14] | 92118208 | 1.00E−118 | *Nitrobacter hamburgensis* X14 | Glyphosate oxidoreductase gene downstream flanking region. | AAR22262 |
| 557, 558 | D-amino-acid dehydrogenase [*Sinorhizobium medicae* WSM419] gi|113726415|gb|EAU07507.1| D-amino-acid dehydrogenase [*Sinorhizobium medicae* WSM419] | 113871743 | 1.00E−132 | *Sinorhizobium medicae* WSM419 | Glyphosate oxidoreductase gene downstream flanking region. | AAR22262 |
| 559, 560 | D-amino-acid dehydrogenase [*Sinorhizobium medicae* WSM419] gi|113726415|gb|EAU07507.1| D-amino-acid dehydrogenase [*Sinorhizobium medicae* WSM419] | 113871743 | 1.00E−132 | *Sinorhizobium medicae* WSM419 | Glyphosate oxidoreductase gene downstream flanking region. | AAR22262 |
| 561, 562 | NADH dehydrogenase [*Xanthomonas axonopodis* pv. *citri* str. 306]. | 21244546 | 1.00E−143 | *Xanthomonas axonopodis* pv. *citri* str. 306 | *M. xanthus* protein sequence, seq id 9726. | ABM91806 |
| 563, 564 | short chain dehydrogenase [*Ralstonia eutropha* JMP134] | 73541108 | 3.00E−66 | *Ralstonia eutropha* JMP134 | *M. xanthus* protein sequence, seq id 9726. | ABM96904 |
| 565, 566 | D-amino-acid dehydrogenase [*Rhodopseudomonas palustris* BisA53] | 115523700 | 1.00E−112 | *Rhodopseudomonas palustris* BisA53 | Glyphosate oxidoreductase gene downstream flanking region. | AAR22262 |
| 567, 568 | D-amino-acid dehydrogenase [*Acidovorax avenae* subsp. *citrulli* AAC00-1] gi|120587303|gb|ABM30743.1| D-amino-acid dehydrogenase [*Acidovorax avenae* subsp. *citrulli* AAC00-1] | 1SEQ ID NO: 9288839 | 0 | *Acidovorax avenae* subsp. *citrulli* AAC00-1 | *P. aeruginosa* virulence gene, VIR14, protein. | ADQ03060 |

TABLE 3-continued

| | | | | | |
|---|---|---|---|---|---|
| 569, 570 | D-amino-acid dehydrogenase [Maricaulis maris MCS10] gi\|114341114\|gb\|ABI66394.1\| D-amino-acid dehydrogenase [Maricaulis maris MCS10] | 114570652 | 8.00E−91 | Maricaulis maris MCS10 | P. aeruginosa virulence gene, VIR14, protein. | ADQ03060 |
| 571, 572 | AGR_L_3050p [Agrobacterium tumefaciens]. | 15891640 | 1.00E−180 | Agrobacterium tumefaciens | P. aeruginosa virulence gene, VIR14, protein. | ADQ03060 |
| 573, 574 | D-amino-acid dehydrogenase [Robiginitalea biformata HTCC2501] gi\|88783849\|gb\|EAR15020.1\| D-amino acid dehydrogenase [Robiginitalea biformata HTCC2501] | 88806240 | 5.00E−85 | Robiginitalea biformata HTCC2501 | Enterobacter cloacae protein amino acid sequence - SEQ ID 5666. | AEH60497 |
| 575, 576 | Aldehyde dehydrogenase [Ralstonia eutropha JMP134] | 72384235 | 1.00E−141 | Ralstonia eutropha JMP134 | Bacterial polypeptide #10001. | ADN22241 |
| 577, 578 | putative d-amino acid dehydrogenase small subunit [Rhizobium leguminosarum bv. viciae 3841] | 116250556 | 1.00E−166 | Rhizobium leguminosarum bv. viciae 3841 | Glyphosate oxidoreductase gene downstream flanking region. | AAR22262 |
| 579, 580 | D-amino-acid dehydrogenase; small subunit protein [Rhizobium etli CFN 42] | 86361166 | 0 | Rhizobium etli CFN 42 | P. aeruginosa virulence gene, VIR14, protein. | ADQ03060 |
| 581, 582 | D-amino-acid dehydrogenase [Ralstonia eutropha JMP134] | 73541345 | 1.00E−136 | Ralstonia eutropha JMP134 | Glyphosate oxidoreductase gene downstream flanking region. | AAR22262 |
| 583, 584 | D-amino-acid dehydrogenase [Burkholderia xenovorans LB400] | 91779297 | 0 | Burkholderia xenovorans LB400 | Glyphosate oxidoreductase gene downstream flanking region. | AAR22262 |
| 585, 586 | D-amino-acid dehydrogenase [Polaromonas naphthalenivorans CJ2] | 121603011 | 0 | Polaromonas naphthalenivorans CJ2 | Photorhabdus luminescens protein sequence #59. | ABM69115 |
| 587, 588 | D-amino acid dehydrogenase; small subunit family protein [Pseudomonas entomophila L48] | 104781752 | 1.00E−139 | Pseudomonas entomophila L48 | Glyphosate oxidoreductase gene downstream flanking region. | AAR22262 |
| 589, 590 | D-amino-acid dehydrogenase small subunit [Rhodococcus sp. RHA1] | 111019145 | 0 | Rhodococcus sp. RHA1 | C glutamicum coding sequence fragment SEQ ID NO: 1935. | AAG93079 |
| 591, 592 | D-amino-acid dehydrogenase [Sinorhizobium medicae WSM419] gi\|113726415\|gb\|EAU07507.1\| D-amino-acid dehydrogenase [Sinorhizobium medicae WSM419] | 113871743 | 1.00E−145 | Sinorhizobium C medicae WSM419 | Glyphosate oxidoreductase gene downstream flanking region. | AAR22262 |
| 593, 594 | D-amino-acid dehydrogenase [Rhodopseudomonas palustris HaA2] | 86750758 | 1.00E−118 | Rhodopseudomonas palustris HaA2 | Glyphosate oxidoreductase gene downstream flanking region. | AAR22262 |
| 595, 596 | D-amino-acid dehydrogenase [Nitrobacter hamburgensis X14] | 92118208 | 0 | Nitrobacter hamburgensis X14 | Glyphosate oxidoreductase gene downstream flanking region. | AAR22262 |
| 597, 598 | D-amino acid dehydrogenase small subunit [Chromobacterium violaceum ATCC 12472] | 34497369 | 0 | Chromobacterium violaceum ATCC 12472 | P. aeruginosa virulence gene, VIR14, protein. | ADQ03060 |
| 599, 600 | D-amino-acid dehydrogenase; small subunit protein [Rhizobium etli CFN 42] | 86361166 | 0 | Rhizobium etli CFN 42 | P. aeruginosa virulence gene, VIR14, protein. | ADQ03060 |
| 601, 602 | D-amino-acid dehydrogenase; small subunit protein [Rhizobium etli CFN 42] | 86361166 | 0 | Rhizobium etli CFN 42 | P. aeruginosa virulence gene, VIR14, protein. | ADQ03060 |
| 603, 604 | D-amino acid dehydrogenase [Flavobacteriales bacterium HTCC2170] gi\|88708933\|gb\|EAR01167.1\| D-amino acid dehydrogenase [Flavobacteriales bacterium HTCC2170] | 88712395 | 2.00E−93 | Flavobacteriales bacterium HTCC2170 | M. catarrhalis protein #1. | ADL05210 |
| 605, 606 | D-amino-acid dehydrogenase [Sinorhizobium medicae WSM419] gi\|113726415\|gb\|EAU07507.1\| D-amino-acid dehydrogenase [Sinorhizobium medicae WSM419] | 113871743 | 1.00E−170 | Sinorhizobium medicae WSM419 | Glyphosate oxidoreductase gene downstream flanking region. | AAR22262 |
| 607, 608 | probable D-amino acid dehydrogenase subunit [Limnobacter sp. MED105] | 149824671 | 1.00E−125 | Limnobacter sp. MED105 | P. aeruginosa virulence gene, VIR14, protein. | ADQ03060 |
| 609, 610 | D-amino-acid dehydrogenase [Ralstonia pickettii 12J] gi\|121302471\|gb\|EAX43440.1\| | 121530396 | 1.00E−146 | Ralstonia pickettii 12J | Glyphosate oxidoreductase gene downstream flanking region. | AAR22262 |

TABLE 3-continued

| SEQ ID | Description | GI # | E-value | Organism | Hit description | Accession |
|---|---|---|---|---|---|---|
| | D-amino-acid dehydrogenase [*Ralstonia pickettii* 12J] | | | | | |
| 611, 612 | D-amino-acid dehydrogenase; small subunit protein [*Rhizobium etli* CFN 42] | 86361166 | 0 | *Rhizobium etli* CFN 42 | *P. aeruginosa* virulence gene, VIR14, protein. | ADQ03060 |
| 613, 614 | D-amino acid dehydrogenase small subunit [*Marinobacter algicola* DG893] | 149377918 | 3.00E−98 | *Marinobacter algicola* DG893 | *N. gonorrhoeae* nucleotide sequence SEQ ID 4691. | ABP80542 |
| 615, 616 | putative d-amino acid dehydrogenase small subunit [*Rhizobium leguminosarum* bv. *viciae* 3841] | 116250556 | 0 | *Rhizobium leguminosarum* bv. *viciae* 3841 | Glyphosate oxidoreductase gene downstream flanking region. | AAR22262 |
| 617, 618 | D-amino-acid dehydrogenase [*Rhodopseudomonas palustris* HaA2] | 86750758 | 1.00E−113 | *Rhodopseudomonas palustris* HaA2 | Glyphosate oxidoreductase gene downstream flanking region. | AAR22262 |
| 619, 620 | aldehyde dehydrogenase [*Burkholderia phymatum* STM815] gi|117986837|gb|EAV01212.1| aldehyde dehydrogenase [*Burkholderia phymatum* STM815] | 118027543 | 1.00E−144 | *Burkholderia phymatum* STM815 | Bacterial polypeptide #10001. | ADN25785 |
| 621, 622 | D-amino acid dehydrogenase [*Flavobacteriales bacterium* HTCC2170] gi|88708933|gb|EAR01167.1| D-amino acid dehydrogenase [*Flavobacteriales bacterium* HTCC2170] | 88712395 | 1.00E−92 | *Flavobacteriales bacterium* HTCC2170 | *Pseudomonas aeruginosa* polypeptide #3. | ABO75104 |
| 623, 624 | D-amino acid dehydrogenase small subunit [*Rhodobacter sphaeroides* 2.4.1] | 77465126 | 1.00E−121 | *Rhodobacter sphaeroides* 2.4.1 | *Photorhabdus luminescens* protein sequence #59. | ABM69115 |
| 625, 626 | D-amino-acid dehydrogenase [*Sphingomonas wittichii* RW1] | 148553731 | 0 | *Sphingomonas wittichii* RW1 | *P. aeruginosa* virulence gene, VIR14, protein. | ADQ03060 |
| 627, 628 | probable D-amino acid dehydrogenase subunit [*Limnobacter* sp. MED105] | 149824671 | 1.00E−151 | *Limnobacter* sp. MED105 | *P. aeruginosa* virulence gene, VIR14, protein. | ADQ03060 |
| 629, 630 | putative dehydrogenase [*Streptomyces parvulus*] | 39725441 | 5.00E−63 | *Streptomyces parvulus* | *Streptomyces parvulus* borrelidin polyketide synthase orfB8 protein. | ADQ74690 |
| 631, 632 | FAD dependent oxidoreductase [*Burkholderia phytofirmans* PsJN] gi|117992233|gb|EAV06525.1| FAD dependent oxidoreductase [*Burkholderia phytofirmans* PsJN] | 118037424 | 0 | *Burkholderia phytofirmans* PsJN | Glyphosate oxidoreductase gene downstream flanking region. | AAR22262 |
| 633, 634 | FAD dependent oxidoreductase [*Delftia acidovorans* SPH-1] gi|118665742|gb|EAV72348.1| FAD dependent oxidoreductase [*Delftia acidovorans* SPH-1] | 118734342 | 0 | *Delftia acidovorans* SPH-1 | *Acinetobacter baumannii* protein #19. | ADA33588 |
| 635, 636 | FAD dependent oxidoreductase [*Delftia acidovorans* SPH-1] gi|118665742|gb|EAV72348.1| FAD dependent oxidoreductase [*Delftia acidovorans* SPH-1] | 118734342 | 0 | *Delftia acidovorans* SPH-1 | *Acinetobacter baumannii* protein #19. | ADA33588 |
| 637, 638 | FAD dependent oxidoreductase [*Pseudomonas fluorescens* PfO-1] | 77457196 | 0 | *Pseudomonas fluorescens* PfO-1 | *Pseudomonas aeruginosa* polypeptide #3. | ABO71517 |
| 639, 640 | oxidoreductase-like [*Roseiflexus castenholzii* DSM 13941] gi|118014488|gb|EAV28464.1| oxidoreductase-like [*Roseiflexus castenholzii* DSM 13941] | 118061388 | 4.00E−72 | *Roseiflexus castenholzii* DSM 13941 | Hyperthermophile *Methanopyrus kandleri* protein #28. | ADM25642 |
| 641, 642 | FAD dependent oxidoreductase [*Pseudomonas fluorescens* PfO-1] | 77457196 | 0 | *Pseudomonas fluorescens* PfO-1 | *Pseudomonas aeruginosa* polypeptide #3. | ABO71517 |
| 643, 644 | Glycine/D-amino acid oxidase [*Magnetospirillum magneticum* AMB-1] | 83311898 | 4.00E−86 | *Magnetospirillum magneticum* AMB-1 | *Pseudomonas aeruginosa* polypeptide #3. | ABO75104 |
| 645, 646 | FAD dependent oxidoreductase [*Chromohalobacter salexigens* DSM 3043] | 92113847 | 1.00E−151 | *Chromohalobacter salexigens* DSM 3043 | Glyphosate oxidoreductase gene downstream flanking region. | AAR22262 |
| 647, 648 | FAD dependent oxidoreductase [*Burkholderia phymatum* STM815] gi|117985258|gb|EAU99635.1| FAD dependent oxidoreductase | 118029195 | 1.00E−165 | *Burkholderia phymatum* STM815 | *Enterobacter cloacae* protein amino acid sequence - SEQ ID 5666. | AEH60497 |

TABLE 3-continued

| | | | | | | |
|---|---|---|---|---|---|---|
| | [Burkholderia phymatum STM815] | | | | | |
| 649, 650 | FAD dependent oxidoreductase [Chromohalobacter salexigens DSM 3043] | 92113847 | 1.00E−146 | Chromohalobacter salexigens DSM 3043 | Glyphosate oxidoreductase gene downstream flanking region. | AAR22262 |
| 651, 652 | putative oxidoreductase protein [Bradyrhizobium japonicum USDA 110] | 27379412 | 1.00E−122 | Bradyrhizobium japonicum USDA 110 | Glyphosate oxidoreductase gene downstream flanking region. | AAR22262 |
| 653, 654 | reductase [Xanthomonas campestris pv. campestris str. 8004] | 66767863 | 1.00E−128 | Xanthomonas campestris pv. campestris str. 8004 | Prokaryotic essential gene #34740. | ABU14721 |
| 655, 656 | FAD dependent oxidoreductase [Nitrobacter winogradskyi Nb-255] | 75676467 | 1.00E−118 | Nitrobacter winogradskyi Nb-255 | Glyphosate oxidoreductase gene downstream flanking region. | AAR22262 |
| 657, 658 | D-aspartate oxidase [Stigmatella aurantiaca DW4/3-1] gi\|115366155\|gb\|EAU65167.1\| D-aspartate oxidase [Stigmatella aurantiaca DW4/3-1] | 115376852 | 3.00E−85 | Stigmatella aurantiaca DW4/3-1 | Human D-aspartate oxidase active site. | AED18771 |
| 659, 660 | FAD dependent oxidoreductase [Dechloromonas aromatica RCB] | 71909453 | 1.00E−142 | Dechloromonas aromatica RCB | P. aeruginosa virulence gene, VIR14, protein. | ADQ03060 |
| 661, 662 | putative secreted protein [Xanthomonas campestris pv. vesicatoria str. 85-10] | 78049397 | 1.00E−102 | Xanthomonas campestris pv. vesicatoria str. 85-10 | Human D-aspartate oxidase active site. | AED18771 |
| 663, 664 | FAD dependent oxidoreductase [Nitrobacter winogradskyi Nb-255] | 75676467 | 1.00E−120 | Nitrobacter winogradskyi Nb-255 | Glyphosate oxidoreductase gene downstream flanking region. | AAR22262 |
| 665, 666 | Glycine/D-amino acid oxidase [Nitrococcus mobilis Nb-231] gi\|88791478\|gb\|EAR22589.1\| Glycine/D-amino acid oxidase [Nitrococcus mobilis Nb-231] | 88810939 | 5.00E−83 | Nitrococcus mobilis Nb-231 | M. catarrhalis protein #1. | ADL05210 |
| 667, 668 | FAD dependent oxidoreductase [Solibacter usitatus Ellin6076] gi\|116227684\|gb\|ABJ86393.1\| FAD dependent oxidoreductase [Solibacter usitatus Ellin6076] | 116624522 | 2.00E−82 | Solibacter usitatus Ellin6076 | Human D-aspartate oxidase active site. | AED18771 |
| 669, 670 | FAD dependent oxidoreductase [Nitrobacter winogradskyi Nb-255] | 75676467 | 1.00E−122 | Nitrobacter winogradskyi Nb-255 | Glyphosate oxidoreductase gene downstream flanking region. | AAR22262 |
| 671, 672 | FAD dependent oxidoreductase [Burkholderia phytofirmans PsJN] gi\|117991720\|gb\|EAV06013.1\| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 |
| 673, 674 | FAD dependent oxidoreductase [Burkholderia phytofirmans PsJN] gi\|117991720\|gb\|EAV06013.1\| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 |
| 675, 676 | FAD dependent oxidoreductase [Burkholderia phytofirmans PsJN] gi\|117991720\|gb\|EAV06013.1\| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 |
| 677, 678 | D-amino-acid oxidase [Nocardioides sp. JS614] gi\|119536676\|gb\|ABL81293.1\| D-amino-acid oxidase [Nocardioides sp. JS614] | 119716015 | 2.00E−51 | Nocardioides sp. JS614 | Human D-aspartate oxidase active site. | AED18771 |
| 679, 680 | FAD dependent oxidoreductase [Delftia acidovorans SPH-1] gi\|118668198\|gb\|EAV74793.1\| FAD dependent oxidoreductase [Delftia acidovorans SPH-1] | 118731339 | 0 | Delftia acidovorans SPH-1 | Pseudomonas aeruginosa polypeptide #3. | ABO71517 |
| 681, 682 | Glycine/D-amino acid oxidase [Nitrococcus mobilis Nb-231] gi\|88791478\|gb\|EAR22589.1\| Glycine/D-amino acid oxidase [Nitrococcus mobilis Nb-231] | 88810939 | 5.00E−94 | Nitrococcus mobilis Nb-231 | P. aeruginosa virulence gene, VIR14, protein. | ADQ03060 |
| 683, 684 | FAD dependent oxidoreductase [Alkalilimnicola ehrlichei MLHE-1] | 114319576 | 2.00E−86 | Alkalilimnicola ehrlichei MLHE-1 | Pseudomonas aeruginosa polypeptide #3. | ABO75104 |

TABLE 3-continued

| | | | | | | |
|---|---|---|---|---|---|---|
| 685, 686 | FAD dependent oxidoreductase [*Alkalilimnicola ehrlichei* MLHE-1] | 114319576 | 5.00E−86 | *Alkalilimnicola ehrlichei* MLHE-1 | *M. catarrhalis* protein #1. | ADL05210 |
| 687, 688 | D-aspartate oxidase [*Stigmatella aurantiaca* DW4/3-1] gi\|115366155\|gb\|EAU65167.1\| D-aspartate oxidase [*Stigmatella aurantiaca* DW4/3-1] | 115376852 | 2.00E−71 | *Stigmatella aurantiaca* DW4/3-1 | Human D-aspartate oxidase active site. | AED18771 |
| 689, 690 | FAD dependent oxidoreductase [*Burkholderia multivorans* ATCC 17616] gi\|118660081\|gb\|EAV66824.1\| FAD dependent oxidoreductase [*Burkholderia multivorans* ATCC 17616] | 118716641 | 1.00E−154 | *Burkholderia multivorans* ATCC 17616 | Glyphosate oxidoreductase gene downstream flanking region. | AAR22262 |
| 691, 692 | FAD dependent oxidoreductase [*Ralstonia metallidurans* CH34] | 94314499 | 1.00E−159 | *Ralstonia metallidurans* CH34 | *Acinetobacter baumannii* protein #19. | ADA36279 |
| 693, 694 | NADH:ubiquinone oxidoreductase 17.2 kD subunit [*Mesorhizobium* sp. BNC1] | 110634071 | 9.00E−58 | *Mesorhizobium* sp. BNC1 | *Drosophila melanogaster* polypeptide SEQ ID NO 24465. | ABB59730 |
| 695, 696 | FAD dependent oxidoreductase [*Ralstonia eutropha* H16] | 116695075 | 1.00E−141 | *Ralstonia eutropha* H16 | *Pseudomonas aeruginosa* polypeptide #3. | ABO71517 |
| 697, 698 | Glycine/D-amino acid oxidase [*Magnetospirillum magneticum* AMB-1] | 83311898 | 1.00E−103 | *Magnetospirillum magneticum* AMB-1 | *P. aeruginosa* virulence gene, VIR14, protein. | ADQ03060 |
| 699, 700 | FAD dependent oxidoreductase [*Nitrobacter winogradskyi* Nb-255] | 75676467 | 1.00E−119 | *Nitrobacter winogradskyi* Nb-255 | Glyphosate oxidoreductase gene downstream flanking region. | AAR22262 |
| 701, 702 | D-aspartate oxidase [*Stigmatella aurantiaca* DW4/3-1] gi\|115366155\|gb\|EAU65167.1\| D-aspartate oxidase [*Stigmatella aurantiaca* DW4/3-1] | 115376852 | 8.00E−51 | *Stigmatella aurantiaca* DW4/3-1 | Human D-aspartate oxidase active site. | AED18771 |
| 703, 704 | FAD dependent oxidoreductase [*Rhodopseudomonas palustris* BisB5] | 91976294 | 1.00E−118 | *Rhodopseudomonas palustris* BisB5 | Glyphosate oxidoreductase gene downstream flanking region. | AAR22262 |
| 705, 706 | putative oxidoreductase protein [*Bradyrhizobium japonicum* USDA 110] | 27379412 | 1.00E−133 | *Bradyrhizobium japonicum* USDA 110 | Glyphosate oxidoreductase gene downstream flanking region. | AAR22262 |
| 707, 708 | FAD dependent oxidoreductase [*Nitrobacter winogradskyi* Nb-255] | 75676467 | 1.00E−121 | *Nitrobacter winogradskyi* Nb-255 | Glyphosate oxidoreductase gene downstream flanking region. | AAR22262 |
| 709, 710 | FAD dependent oxidoreductase [*Burkholderia phymatum* STM815] gi\|117979745\|gb\|EAU94152.1\| FAD dependent oxidoreductase [*Burkholderia phymatum* STM815] | 118034565 | 0 | *Burkholderia phymatum* STM815 | Glyphosate oxidoreductase gene downstream flanking region. | AAR22262 |
| 711, 712 | FAD dependent oxidoreductase [*Alkalilimnicola ehrlichei* MLHE-1] | 114319576 | 1.00E−88 | *Alkalilimnicola ehrlichei* MLHE-1 | *P. aeruginosa* virulence gene, VIR14, protein. | ADQ03060 |
| 713, 714 | FAD dependent oxidoreductase [*Burkholderia phymatum* STM815] gi\|117979745\|gb\|EAU94152.1\| FAD dependent oxidoreductase [*Burkholderia phymatum* STM815] | 118034565 | 0 | *Burkholderia phymatum* STM815 | Glyphosate oxidoreductase gene downstream flanking region. | AAR22262 |
| 715, 716 | FAD dependent oxidoreductase [*Magnetospirillum gryphiswaldense* MSR-1] | 144897812 | 4.00E−87 | *Magnetospirillum gryphiswaldense* MSR-1 | *Pseudomonas aeruginosa* polypeptide #3. | ABO75104 |
| 717, 718 | FAD dependent oxidoreductase, putative [*Microscilla marina* ATCC 23134] gi\|123987451\|gb\|EAY27171.1\| FAD dependent oxidoreductase, putative [*Microscilla marina* ATCC 23134] | 124006998 | 4.00E−29 | *Microscilla marina* ATCC 23134 | *H. pylori* GHPO 1099 gene. | AAW98270 |
| 719, 720 | FAD dependent oxidoreductase [*Nitrobacter winogradskyi* Nb-255] | 75676467 | 1.00E−137 | *Nitrobacter winogradskyi* Nb-255 | Glyphosate oxidoreductase gene downstream flanking region. | AAR22262 |
| 721, 722 | D-amino-acid oxidase [*Nocardioides* sp. JS614] gi\|119536676\|gb\|ABL81293.1\| D-amino-acid oxidase [*Nocardioides* sp. JS614] | 119716015 | 7.00E−53 | *Nocardioides* sp. JS614 | Human D-aspartate oxidase active site. | AED18771 |
| 723, 724 | Glycine/D-amino acid oxidase [*Nitrococcus mobilis* Nb-231] gi\|88791478\|gb\|EAR22589.1\| | 88810939 | 2.00E−84 | *Nitrococcus mobilis* Nb-231 | *Pseudomonas aeruginosa* polypeptide #3. | ABO75104 |

TABLE 3-continued

| | | | | | | |
|---|---|---|---|---|---|---|
| | Glycine/D-amino acid oxidase [*Nitrococcus mobilis* Nb-231] | | | | | |
| 725, 726 | FAD dependent oxidoreductase [*Dechloromonas aromatica* RCB] | 71909453 | 1.00E−133 | *Dechloromonas aromatica* RCB | *Enterobacter cloacae* protein amino acid sequence - SEQ ID 5666. | AEH60497 |
| 727, 728 | D-amino acid dehydrogenase small subunit [*Marinobacter algicola* DG893] | 149377918 | 1.00E−136 | *Marinobacter algicola* DG893 | *Photorhabdus luminescens* protein sequence #59. | ABM69115 |
| 729, 730 | pyruvate flavodoxin/ferredoxin oxidoreductase domain protein [*Alkalilimnicola ehrlichei* MLHE-1] | 114319858 | 1.00E−135 | *Alkalilimnicola ehrlichei* MLHE-1 | *Staphylococcus aureus* protein #10. | ABM73103 |
| 731, 732 | FAD dependent oxidoreductase [*Magnetospirillum gryphiswaldense* MSR-1] | 144897812 | 4.00E−80 | *Magnetospirillum gryphiswaldense* MSR-1 | *Klebsiella pneumoniae* polypeptide seqid 7178. | ABO67618 |
| 733, 734 | FAD dependent oxidoreductase [*Magnetospirillum gryphiswaldense* MSR-1] | 144897812 | 1.00E−89 | *Magnetospirillum gryphiswaldense* MSR-1 | *Pseudomonas aeruginosa* polypeptide #3. | ABO75104 |
| 735, 736 | FAD linked oxidase domain protein [*Methylobacterium* sp. 4-46] | 149124512 | 3.00E−61 | *Methylobacterium* sp. 4-46 | FAD-dependent-D-erythronate 4-phosphate dehydrogenase. | ADM97925 |
| 737, 738 | FAD dependent oxidoreductase [*Chromohalobacter salexigens* DSM 3043] | 92113847 | 1.00E−150 | *Chromohalobacter salexigens* DSM 3043 | Glyphosate oxidoreductase gene downstream flanking region. | AAR20642 |
| 739, 740 | FAD dependent oxidoreductase [*Chromohalobacter salexigens* DSM 3043] | 92113847 | 1.00E−153 | *Chromohalobacter salexigens* DSM 3043 | Glyphosate oxidoreductase gene downstream flanking region. | AAR22262 |
| 741, 742 | FAD dependent oxidoreductase [*Chromohalobacter salexigens* DSM 3043] | 92113847 | 1.00E−153 | *Chromohalobacter salexigens* DSM 3043 | Glyphosate oxidoreductase gene downstream flanking region. | AAR22262 |
| 743, 744 | FAD dependent oxidoreductase [*Chromohalobacter salexigens* DSM 3043] | 92113847 | 1.00E−150 | *Chromohalobacter salexigens* DSM 3043 | Glyphosate oxidoreductase gene downstream flanking region. | AAR20642 |
| 745, 746 | FAD dependent oxidoreductase [*Ralstonia metallidurans* CH34] | 94314005 | 1.00E−101 | *Ralstonia metallidurans* CH34 | *Pseudomonas aeruginosa* polypeptide #3. | ABO71517 |
| 747, 748 | glycine/D-amino acid oxidase [*Parvibaculum lavamentivorans* DS-1] gi\|121298521\|gb\|EAX39710.1\| glycine/D-amino acid oxidase [*Parvibaculum lavamentivorans* DS-1] | 121525574 | 1.00E−125 | *Parvibaculum lavamentivorans* DS-1 | *P. aeruginosa* virulence gene, VIR14, protein. | ADQ03060 |
| 749, 750 | FAD dependent oxidoreductase [*Dechloromonas aromatica* RCB] | 71909453 | 1.00E−139 | *Dechloromonas aromatica* RCB | *P. aeruginosa* virulence gene, VIR14, protein. | ADQ03060 |
| 751, 752 | monooxygenase, FAD-binding [*Comamonas testosteroni* KF-1] gi\|118002385\|gb\|EAV16539.1\| monooxygenase, FAD-binding [*Comamonas testosteroni* KF-1] | 118050299 | 8.00E−81 | *Comamonas testosteroni* KF-1 | Farnesyl dibenzodiazepinone biosynthetic ORF9 protein HMGA, SEQ ID 18. | ADR01274 |
| 753, 754 | FAD dependent oxidoreductase [*Nitrobacter winogradskyi* Nb-255] | 75676467 | 1.00E−120 | *Nitrobacter winogradskyi* Nb-255 | Glyphosate oxidoreductase gene downstream flanking region. | AAR22262 |
| 755, 756 | FAD dependent oxidoreductase [*Rhodopseudomonas palustris* BisB5] | 91976294 | 1.00E−121 | *Rhodopseudomonas palustris* BisB5 | Glyphosate oxidoreductase gene downstream flanking region. | AAR22262 |
| 757, 758 | putative oxidoreductase protein [*Sagittula stellata* E-37] gi\|126707413\|gb\|EBA06477.1\| putative oxidoreductase protein [*Sagittula stellata* E-37] | 126732124 | 1.00E−131 | *Sagittula stellata* E-37 | Glyphosate oxidoreductase gene downstream flanking region. | AAR22262 |
| 759, 760 | FAD dependent oxidoreductase [*Nitrobacter winogradskyi* Nb-255] | 75676467 | 1.00E−113 | *Nitrobacter winogradskyi* Nb-255 | Glyphosate oxidoreductase gene downstream flanking region. | AAR22262 |
| 761, 762 | FAD dependent oxidoreductase [*Chromohalobacter salexigens* DSM 3043] | 92113847 | 1.00E−149 | *Chromohalobacter salexigens* DSM 3043 | Glyphosate oxidoreductase gene downstream flanking region. | AAR20642 |
| 763, 764 | FAD dependent oxidoreductase [*Alkalilimnicola ehrlichei* MLHE-1] | 114319576 | 4.00E−84 | *Alkalilimnicola ehrlichei* MLHE-1 | *Pseudomonas aeruginosa* polypeptide #3. | ABO75104 |
| 765, 766 | FAD linked oxidase domain protein [*Methylobacterium* sp. 4-46] | 149124512 | 1.00E−106 | *Methylobacterium* sp. 4-46 | FAD-dependent-D-erythronate 4-phosphate dehydrogenase. | ADM97925 |
| 767, 768 | FAD dependent oxidoreductase [*Alkalilimnicola ehrlichei* MLHE-1] | 114319576 | 3.00E−84 | *Alkalilimnicola ehrlichei* MLHE-1 | *Pseudomonas aeruginosa* polypeptide #3. | ABO75104 |
| 769, 770 | FAD dependent oxidoreductase [*Chromohalobacter salexigens* DSM 3043] | 92113847 | 1.00E−149 | *Chromohalobacter salexigens* DSM 3043 | Glyphosate oxidoreductase gene downstream flanking region. | AAR20642 |

TABLE 3-continued

| | | | | | | |
|---|---|---|---|---|---|---|
| 771, 772 | FAD dependent oxidoreductase [*Nitrobacter winogradskyi* Nb-255] | 75676467 | 1.00E−121 | *Nitrobacter winogradskyi* Nb-255 | Glyphosate oxidoreductase gene downstream flanking region. | AAR22262 |
| 773, 774 | FAD dependent oxidoreductase [*Chromohalobacter salexigens* DSM 3043] | 92113847 | 1.00E−149 | *Chromohalobacter salexigens* DSM 3043 | Glyphosate oxidoreductase gene downstream flanking region. | AAR22262 |
| 775, 776 | Glycine/D-amino acid oxidase [*Nitrococcus mobilis* Nb-231] gi|88791478|gb|EAR22589.1| Glycine/D-amino acid oxidase [*Nitrococcus mobilis* Nb-231] | 88810939 | 5.00E−77 | *Nitrococcus mobilis* Nb-231 | *N. gonorrhoeae* nucleotide sequence SEQ ID 4691. | ABP80542 |
| 777, 778 | putative oxidoreductase protein [*Bradyrhizobium japonicum* USDA 110] | 27379412 | 0 | *Bradyrhizobium japonicum* USDA 110 | Glyphosate oxidoreductase gene downstream flanking region. | AAR22262 |
| 779, 780 | FAD dependent oxidoreductase [*Burkholderia phytofirmans* PsJN] gi|117992233|gb|EAV06525.1| FAD dependent oxidoreductase [*Burkholderia phytofirmans* PsJN] | 118037424 | 0 | *Burkholderia phytofirmans* PsJN | Glyphosate oxidoreductase gene downstream flanking region. | AAR22262 |
| 781, 782 | FAD dependent oxidoreductase [*Stappia aggregata* IAM 12614] gi|118434190|gb|EAV40846.1| FAD dependent oxidoreductase [*Stappia aggregata* IAM 12614] | 118593299 | 1.00E−122 | *Stappia aggregata* IAM 12614 | Glyphosate oxidoreductase gene downstream flanking region. | AAR22262 |
| 783, 784 | FAD linked oxidase domain protein [*Methylobacterium* sp. 4-46] | 149124512 | 7.00E−99 | *Methylobacterium* sp. 4-46 | FAD-dependent-D-erythronate 4-phosphate dehydrogenase. | ADM97925 |
| 785, 786 | FAD dependent oxidoreductase [*Alkalilimnicola ehrlichei* MLHE-1] | 114319576 | 1.00E−84 | *Alkalilimnicola ehrlichei* MLHE-1 | *Pseudomonas aeruginosa* polypeptide #3. | ABO75104 |
| 787, 788 | FAD dependent oxidoreductase [*Magnetospirillum gryphiswaldense* MSR-1] | 144897812 | 9.00E−85 | *Magnetospirillum gryphiswaldense* MSR-1 | *Pseudomonas aeruginosa* polypeptide #3. | ABO75104 |
| 789, 790 | putative oxidoreductase protein [*Sagittula stellata* E-37] gi|126707413|gb|EBA06477.1| putative oxidoreductase protein [*Sagittula stellata* E-37] | 126732124 | 1.00E−107 | *Sagittula stellata* E-37 | Glyphosate oxidoreductase gene downstream flanking region. | AAR22262 |
| 791, 792 | Oxidoreductase, N-terminal:Dihydrodipicolinate reductase [*Halothermothrix orenii* H 168] gi|89158855|gb|EAR78543.1| Oxidoreductase, N-terminal:Dihydrodipicolinate reductase [*Halothermothrix orenii* H 168] | 89211549 | 2.00E−98 | *Halothermothrix orenii* H 168 | *Propionibacterium acnes* predicted ORF-encoded polypeptide #300. | BM37055 |
| 793, 794 | PUTATIVE OXIDOREDUCTASE PROTEIN [*Sinorhizobium meliloti*]. | 15964495 | 1.00E−149 | *Sinorhizobium meliloti* | Glyphosate oxidoreductase gene downstream flanking region. | AAR22262 |
| 795, 796 | indolepyruvate ferredoxin oxidoreductase [*Stappia aggregata* IAM 12614] gi|118434188|gb|EAV40844.1| indolepyruvate ferredoxin oxidoreductase [*Stappia aggregata* IAM 12614] | 118593297 | 0 | *Stappia aggregata* IAM 12614 | *Acinetobacter baumannii* protein #19. | ADA35170 |
| 797, 798 | FAD linked oxidase domain protein [*Methylobacterium* sp. 4-46] | 149124512 | 1.00E−128 | *Methylobacterium* sp. 4-46 | FAD-dependent-D-erythronate 4-phosphate dehydrogenase. | ADM97925 |
| 799, 800 | FAD dependent oxidoreductase [*Alkalilimnicola ehrlichei* MLHE-1] | 114319576 | 9.00E−90 | *Alkalilimnicola ehrlichei* MLHE-1 | *M. catarrhalis* protein #1. | ADL05210 |
| 801, 802 | FAD dependent oxidoreductase [*Magnetospirillum gryphiswaldense* MSR-1] | 144897812 | 1.00E−89 | *Magnetospirillum gryphiswaldense* MSR-1 | *Pseudomonas aeruginosa* polypeptide #3. | ABO75104 |
| 803, 804 | FAD dependent oxidoreductase [*Alkalilimnicola ehrlichei* MLHE-1] | 114319576 | 1.00E−86 | *Alkalilimnicola ehrlichei* MLHE-1 | *P. aeruginosa* virulence gene, VIR14, protein. | ADQ03060 |
| 805, 806 | FAD linked oxidase domain protein [*Methylobacterium* sp. 4-46] | 149124512 | 1.00E−121 | *Methylobacterium* sp. 4-46 | FAD-dependent-D-erythronate 4-phosphate dehydrogenase. | ADM97925 |
| 807, 808 | D-amino acid dehydrogenase small subunit [*Marinobacter algicola* DG893] | 149377918 | 1.00E−135 | *Marinobacter algicola* DG893 | *Photorhabdus luminescens* protein sequence #59. | ABM69115 |

TABLE 3-continued

| | | | | | | |
|---|---|---|---|---|---|---|
| 809, 810 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 |
| 811, 812 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 |
| 813, 814 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 |
| 815, 816 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 |
| 817, 818 | FAD dependent oxidoreductase [*Alkalilimnicola ehrlichei* MLHE-1] | 114319576 | 5.00E−93 | *Alkalilimnicola ehrlichei* MLHE-1 | *P. aeruginosa* virulence gene, VIR14, protein. | ADQ03060 |
| 819, 820 | FAD dependent oxidoreductase [*Magnetospirillum gryphiswaldense* MSR-1] | 144897812 | 1.00E−124 | *Magnetospirillum gryphiswaldense* MSR-1 | *P. aeruginosa* virulence gene, VIR14, protein. | ADQ03060 |
| 821, 822 | FAD dependent oxidoreductase [*Chromohalobacter salexigens* DSM 3043] | 92113847 | 1.00E−150 | *Chromohalobacter salexigens* DSM 3043 | Glyphosate oxidoreductase gene downstream flanking region. | AAR20642 |
| 823, 824 | hypothetical protein, contains weak similarity to sarcosine oxidase [*Mesorhizobium loti*]. | 13473721 | 1.00E−176 | *Mesorhizobium loti* | Human Her-2/neu over expression modulated protein (HOMPS) H14 cDNA. | AAE00797 |
| 825, 826 | FAD dependent oxidoreductase [*Delftia acidovorans* SPH-1] gi|118668198|gb|EAV74793.1| FAD dependent oxidoreductase [*Delftia acidovorans* SPH-1] | 118731339 | 0 | *Delftia acidovorans* SPH-1 | *Pseudomonas aeruginosa* polypeptide #3. | ABO71517 |
| 827, 828 | FAD dependent oxidoreductase [*Stappia aggregata* IAM 12614] gi|118434190|gb|EAV40846.1| FAD dependent oxidoreductase [*Stappia aggregata* IAM 12614] | 118593299 | 1.00E−122 | *Stappia aggregata* IAM 12614 | Glyphosate oxidoreductase gene downstream flanking region. | AAR22262 |
| 829, 830 | FAD dependent oxidoreductase [*Alkalilimnicola ehrlichei* MLHE-1] | 114319576 | 2.00E−87 | *Alkalilimnicola ehrlichei* MLHE-1 | *Pseudomonas aeruginosa* polypeptide #3. | ABO75104 |
| 831, 832 | hypothetical protein [*Mesorhizobium loti*]. | 13475565 | 7.00E−99 | *Mesorhizobium loti* | *Pseudomonas aeruginosa* polypeptide #3. | ABO71517 |
| 833, 834 | FAD dependent oxidoreductase [*Magnetospirillum gryphiswaldense* MSR-1] | 144897812 | 2.00E−89 | *Magnetospirillum gryphiswaldense* MSR-1 | *Pseudomonas aeruginosa* polypeptide #3. | ABO75104 |
| 835, 836 | FAD linked oxidase domain protein [*Methylobacterium* sp. 4-46] | 149124512 | 1.00E−123 | *Methylobacterium* sp. 4-46 | FAD-dependent-D-erythronate 4-phosphate dehydrogenase. | ADM97925 |
| 837, 838 | D-aspartate oxidase [*Stigmatella aurantiaca* DW4/3-1] gi|115366155|gb|EAU65167.1| D-aspartate oxidase [*Stigmatella aurantiaca* DW4/3-1] | 115376852 | 1.00E−56 | *Stigmatella aurantiaca* DW4/3-1 | Human D-aspartate oxidase active site. | AED18771 |
| 839, 840 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 |
| 841, 842 | FAD dependent oxidoreductase [*Dechloromonas aromatica* RCB] | 71909453 | 1.00E−126 | *Dechloromonas aromatica* RCB | *P. aeruginosa* virulence gene, VIR14, protein. | ADQ03060 |
| 843, 844 | FAD dependent oxidoreductase [*Burkholderia phymatum* STM815] gi|117985258|gb|EAU99635.1| | 118029195 | 1.00E−180 | *Burkholderia phymatum* STM815 | *Enterobacter cloacae* protein amino acid sequence - SEQ ID 5666. | AEH60497 |

TABLE 3-continued

| | | | | | | |
|---|---|---|---|---|---|---|
| | FAD dependent oxidoreductase [*Burkholderia phymatum* STM815] | | | | | |
| 845, 846 | putative oxidoreductase protein [*Bradyrhizobium japonicum* USDA 110] | 27379412 | 0 | *Bradyrhizobium japonicum* USDA 110 | Glyphosate oxidoreductase gene downstream flanking region. | AAR22262 |
| 847, 848 | FAD dependent oxidoreductase [*Pseudomonas fluorescens* PfO-1] | 77457196 | 1.00E-171 | *Pseudomonas fluorescens* PfO-1 | *Pseudomonas aeruginosa* polypeptide #3. | ABO71517 |
| 849, 850 | FAD dependent oxidoreductase [*Alkalilimnicola ehrlichei* MLHE-1] | 114319576 | 7.00E-93 | *Alkalilimnicola ehrlichei* MLHE-1 | *P. aeruginosa* virulence gene, VIR14, protein. | ADQ03060 |
| 851, 852 | D-amino acid oxidase [*Arthrobacter protophormiae*]. | 32140775 | 1.00E-62 | *Arthrobacter protophormiae* | Primer Aprev4 #SEQ ID 8. | ADF68144 |
| 853, 854 | FAD dependent oxidoreductase [*Pseudomonas fluorescens* PfO-1] | 77457196 | 1.00E-171 | *Pseudomonas fluorescens* PfO-1 | *Pseudomonas aeruginosa* polypeptide #3. | ABO71517 |
| 855, 856 | FAD dependent oxidoreductase [*Comamonas testosteroni* KF-1] gi\|118001016\|gb\|EAV15172.1\| FAD dependent oxidoreductase [*Comamonas testosteroni* KF-1] | 118051673 | 0 | *Comamonas testosteroni* KF-1 | *Pseudomonas aeruginosa* polypeptide #3. | ABO71517 |
| 857, 858 | FAD dependent oxidoreductase [*Comamonas testosteroni* KF-1] gi\|118001016\|gb\|EAV15172.1\| FAD dependent oxidoreductase [*Comamonas testosteroni* KF-1] | 118051673 | 0 | *Comamonas testosteroni* KF-1 | *Pseudomonas aeruginosa* polypeptide #3. | ABO71517 |
| 859, 860 | FAD dependent oxidoreductase [*Comamonas testosteroni* KF-1] gi\|118001016\|gb\|EAV15172.1\| FAD dependent oxidoreductase [*Comamonas testosteroni* KF-1] | 118051673 | 0 | *Comamonas testosteroni* KF-1 | *Pseudomonas aeruginosa* polypeptide #3. | ABO71517 |
| 861, 862 | D-amino acid oxidase [*Rubrobacter xylanophilus* DSM 9941] | 108803375 | 3.00E-70 | *Rubrobacter xylanophilus* DSM 9941 | Human D-aspartate oxidase active site. | AED18771 |
| 863, 864 | D-amino acid dehydrogenase small subunit [*Pseudomonas syringae* pv. *syringae* B728a] | 66043505 | 0 | *Pseudomonas syringae* pv. *syringae* B728a | *P. aeruginosa* virulence gene, VIR14, protein. | ADQ03060 |
| 865, 866 | | | | *Lactobacillus salivarius* subsp. *salivarius* UCC118 | | ABM71198 |
| 867, 868 | | | | *Methanococcus maripaludis* C7 | | ADS43070 |
| 869, 870 | | | | | | AEM18037 |
| 871, 872 | | | | *Planctomyces maris* DSM 8797 | | ADN26446 |
| 873, 874 | | | | *Planctomyces maris* DSM 8797 | | ADN26446 |
| 875, 876 | | | | *Roseiflexus castenholzii* DSM 13941 | | ADN26446 |
| 877, 878 | | | | *Planctomyces maris* DSM 8797 | | ADN26446 |
| 879, 880 | | | | *Planctomyces maris* DSM 8797 | | ADN26446 |
| 881, 882 | | | | *Oceanobacter* sp. RED65 | | AEB37927 |
| 883, 884 | | | | *Thiobacillus denitrificans* ATCC 25259 | | AEM18040 |
| 885, 886 | | | | *Clostridium beijerinckii* NCIMB 8052 | | AEM18031 |
| 887, 888 | | | | *Nocardioides* sp. JS614 | | AEK20408 |
| 889, 890 | | | | *Methylococcus capsulatus* str. Bath | | ABM71198 |
| 891, 892 | | | | *Clostridium beijerinckii* NCIMB 8052 | | ABB08244 |
| 893, 894 | | | | *Clostridium beijerinckii* NCIMB 8052 | | ABB08244 |
| 895, 896 | | | | *Clostridium acetobutylicum* ATCC 824 | | ABU32980 |
| 897, 898 | | | | *Roseiflexus castenholzii* DSM 13941 | | ADN26446 |

TABLE 3-continued

| SEQ ID | Description | GI# | E-value | Organism | Note | Accession |
|---|---|---|---|---|---|---|
| 899, 900 | | | | *Planctomyces maris* DSM 8797 | | ADN26446 |
| 901, 902 | | | | *Planctomyces maris* DSM 8797 | | ADN26446 |
| 903, 904 | | | | *Planctomyces maris* DSM 8797 | | ADN26446 |
| 905, 906 | | | | *Rhodobacter sphaeroides* 2.4.1 | | ADF03944 |
| 907, 908 | | | | *Streptomyces avermitilis* MA-4680 | | AEK20408 |
| 909, 910 | | | | *Bacillus* sp. B14905 | | ADW43694 |
| 911, 912 | | | | *Azoarcus* sp. EbN1 | | ABU33175 |
| 913, 914 | | | | *Bacillus licheniformis* ATCC 14580 | | AEM18039 |
| 915, 916 | | | | *Roseiflexus castenholzii* DSM 13941 | | ADN26446 |
| 917, 918 | | | | *Robiginitalea biformata* HTCC2501 | | AAY13560 |
| 919, 920 | | | | *Planctomyces maris* DSM 8797 | | ADN26446 |
| 921, 922 | | | | *Planctomyces maris* DSM 8797 | | ADN26446 |
| 923, 924 | | | | *Roseobacter* sp. MED193 | | ADF03944 |
| 925, 926 | | | | *Planctomyces maris* DSM 8797 | | ADN26446 |
| 927, 928 | | | | *Aquifex aeolicus* VF5 | | ADN17496 |
| 929, 930 | | | | *Aspergillus terreus* NIH2624 | | ADS78245 |
| 931, 932 | | | | *Oceanicola granulosus* HTCC2516 | | ADS78325 |
| 933, 934 | | | | *Pyrococcus horikoshii* OT3 | | ADS41897 |
| 935, 936 | | | | *Aeromonas hydrophila* subsp. *hydrophila* ATCC 7966 | | ADS78291 |
| 937, 938 | | | | *Silicibacter* sp. TM1040 | | ADF03944 |
| 939, 940 | | | | *Rhodopseudomonas palustris* CGA009 | | ADF03944 |
| 941, 942 | | | | *Xanthobacter autotrophicus* Py2 | | ADF03944 |
| 943, 944 | | | | *Azoarcus* sp. BH72 | | AEM18040 |
| 945, 946 | | | | *Clostridium beijerinckii* NCIMB 8052 | | AEM18031 |
| 947, 948 | | | | *Alcanivorax borkumensis* SK2 | | AAY13560 |
| 949, 950 | | | | | | ABU21638 |
| 951, 952 | aspartate aminotransferase [*Pyrococcus horikoshii*]. | 14590640 | 2.00E−52 | *Pyrococcus horikoshii* | Bacterial polypeptide #23667. | ADS41897 |
| 953, 954 | aspartate aminotransferase [*Aquifex aeolicus*]. | 15606968 | 0 | *Aquifex aeolicus* | Bacterial polypeptide #23667. | ADN17496 |
| 955, 956 | conserved hypothetical protein [*Aspergillus terreus* NIH2624] | 115385557 | 1.00E−126 | *Aspergillus terreus* NIH2624 | Aminotransferase/mutase/deaminase enzyme #14. | ADS78245 |
| 957, 958 | hypothetical protein OG2516_15919 [*Oceanicola granulosus* HTCC2516] gi\|89043511\|gb\|EAR49723.1\| hypothetical protein OG2516_15919 [*Oceanicola granulosus* HTCC2516] | 89070918 | 0 | *Oceanicola granulosus* HTCC2516 | Aminotransferase/mutase/deaminase enzyme #14. | ADS78325 |

TABLE 3-continued

| | | | | | | | | | |
|---|---|---|---|---|---|---|---|---|---|
| 959, 960 | aminotransferase; class III [*Aeromonas hydrophila* subsp. *hydrophila* ATCC 7966] | 117619456 | 1.00E−158 | *Aeromonas hydrophila* subsp. *hydrophila* ATCC 7966 | | Aminotransferase/mutase/deaminase enzyme #14. | | ADS78291 | |

| Geneseq DNA Accession Code | Evalue | Predicted EC Number | Query DNA Length | Query Protein Length | Subject DNA Length | Subject Protein Length | % ID Protein | SEQ ID NO: |
|---|---|---|---|---|---|---|---|---|
| ADS78244 | 0 | 2.6.1.42 | 879 | 292 | 954 | 317 | | 1, 2 |
| ADJ41018 | 2.4 | 2.6.1.21 | 855 | 284 | 0 | 286 | 66 | 3, 4 |
| ADI39160 | 0.61 | 2.6.1.21 | 855 | 284 | 0 | 285 | 51 | 5, 6 |
| ABZ69309 | 0.16 | 2.6.1.21 | 870 | 289 | 0 | 285 | 58 | 7, 8 |
| ACA26397 | 0.28 | 2.6.1.21 | 435 | 144 | 0 | 286 | 60 | 9, 10 |
| ABL17260 | 2.5 | 2.6.1.21 | 879 | 292 | 0 | 285 | 56 | 11, 12 |
| AAH32576 | 0.039 | 2.6.1.21 | 855 | 284 | 0 | 282 | 63 | 13, 14 |
| ADE99771 | 0.038 | 2.6.1.21 | 837 | 278 | 0 | 294 | 45 | 15, 16 |
| | 0 | 2.6.1.42 | 918 | 305 | 0 | 306 | 34 | 17, 18 |
| ABL03988 | 2.4 | 2.6.1.21 | 861 | 286 | 0 | 282 | 61 | 19, 20 |
| ACF71263 | 2.4 | 2.6.1.21 | 861 | 286 | 0 | 282 | 63 | 21, 22 |
| ADA66322 | 0.16 | 2.6.1.21 | 861 | 286 | 0 | 282 | 61 | 23, 24 |
| ABN23130 | 0.6 | 2.6.1.21 | 840 | 279 | 0 | 283 | 55 | 25, 26 |
| ADL15020 | 0.57 | 2.6.1.42 | 801 | 266 | 0 | 274 | 37 | 27, 28 |
| AAK71577 | 0.6 | 2.6.1.21 | 849 | 282 | 843 | 280 | 51 | 29, 30 |
| ABA15896 | 0.003 | 2.6.1.9 | 1062 | 353 | 0 | 371 | 32 | 31, 32 |
| ABQ69245 | 4.00E−08 | 2.6.1.21 | 852 | 283 | 0 | 283 | 66 | 33, 34 |
| ABD13518 | 0.21 | 2.9.1.1 | 1143 | 380 | 0 | 388 | 35 | 35, 36 |
| ABN18447 | 0.017 | 5.4.3.8 | 1389 | 462 | 0 | 455 | 43 | 37, 38 |
| ADO84697 | 0.05 | 2.6.1.45 | 1080 | 359 | 0 | 397 | 48 | 39, 40 |
| AAN81507 | 1.00E−20 | 2.6.1.21 | 852 | 283 | 0 | 282 | 76 | 41, 42 |
| ABL08182 | 0.99 | 5.4.3.8 | 1350 | 449 | 0 | 455 | 48 | 43, 44 |
| ACA25362 | 6.00E−08 | 2.6.1.45 | 1170 | 389 | 0 | 397 | 51 | 45, 46 |
| ACA62990 | 0.066 | 5.4.3.8 | 1401 | 466 | 0 | 455 | 42 | 47, 48 |
| ADS63519 | 7.00E−08 | 5.4.3.8 | 1353 | 450 | 0 | 454 | 49 | 49, 50 |
| ADH48029 | 1.00E−09 | 5.4.3.8 | 1344 | 447 | 0 | 454 | 47 | 51, 52 |
| ACA53304 | 2.4 | 2.6.1.21 | 861 | 286 | 0 | 281 | 49 | 53, 54 |
| ABD17818 | 4.00E−34 | 2.6.1.1 | 399 | 132 | 0 | 396 | 94 | 55, 56 |
| ABD17818 | 6.00E−36 | 2.6.1.1 | 399 | 132 | 0 | 396 | 93 | 57, 58 |
| ABD17818 | 9.00E−29 | 2.6.1.1 | 399 | 132 | 0 | 396 | 93 | 59, 60 |
| ABD17818 | 1.00E−34 | 2.6.1.1 | 399 | 132 | 0 | 396 | 94 | 61, 62 |
| ABD17818 | 7.00E−48 | 2.6.1.1 | 399 | 132 | 0 | 396 | 93 | 63, 64 |
| ABD17818 | 5.00E−52 | 2.6.1.1 | 399 | 132 | 615 | 410 | | 65, 66 |
| ABD17818 | 4.00E−46 | 2.6.1.1 | 399 | 132 | 615 | 410 | | 67, 68 |
| ABD17818 | 1.00E−43 | 2.6.1.1 | 399 | 132 | 615 | 410 | | 69, 70 |
| ABD17818 | 5.00E−52 | 2.6.1.1 | 399 | 132 | 0 | 396 | 96 | 71, 72 |
| ABD17818 | 5.00E−52 | 2.6.1.1 | 399 | 132 | 0 | 396 | 96 | 73, 74 |
| ABD03911 | 2.5 | 2.6.1.21 | 873 | 290 | 0 | 285 | 57 | 75, 76 |
| ABD03911 | 2.5 | 2.6.1.21 | 873 | 290 | 0 | 285 | 57 | 77, 78 |
| ABD17818 | 7.00E−42 | 2.6.1.1 | 396 | 131 | 0 | 396 | 93 | 79, 80 |
| ABD17818 | 1.00E−40 | 2.6.1.1 | 396 | 131 | 0 | 396 | 94 | 81, 82 |
| ADS58845 | 0.017 | 5.4.3.8 | 1398 | 465 | 0 | 455 | 41 | 83, 84 |
| AAI99682 | 0.62 | 2.6.1.21 | 873 | 290 | 0 | 286 | 46 | 85, 86 |
| ACL13803 | 9.8 | 2.6.1.21 | 879 | 292 | 0 | 282 | 40 | 87, 88 |
| ABD17818 | 4.00E−34 | 2.6.1.1 | 399 | 132 | 0 | 396 | 93 | 89, 90 |
| ABD17818 | 3.00E−53 | 2.6.1.1 | 399 | 132 | 0 | 396 | 93 | 91, 92 |
| ABD17818 | 8.00E−54 | 2.6.1.1 | 399 | 132 | 0 | 396 | 93 | 93, 94 |
| ABD17818 | 8.00E−54 | 2.6.1.1 | 399 | 132 | 0 | 396 | 93 | 95, 96 |
| ABD17818 | 5.00E−55 | 2.6.1.1 | 399 | 132 | 0 | 396 | 93 | 97, 98 |
| ABD17818 | 3.00E−44 | 2.6.1.1 | 393 | 130 | 0 | 396 | 96 | 99, 100 |
| ABD17818 | 8.00E−54 | 2.6.1.1 | 396 | 131 | 0 | 396 | 97 | 101, 102 |
| ABD17818 | 8.00E−60 | 2.6.1.1 | 399 | 132 | 0 | 396 | 95 | 103, 104 |
| ABD17818 | 5.00E−55 | 2.6.1.1 | 399 | 132 | 0 | 396 | 94 | 105, 106 |
| ABD17818 | 8.00E−54 | 2.6.1.1 | 399 | 132 | 0 | 396 | 93 | 107, 108 |
| ABD17818 | 5.00E−49 | 2.6.1.1 | 399 | 132 | 0 | 396 | 93 | 109, 110 |
| ABD17818 | 5.00E−52 | 2.6.1.1 | 399 | 132 | 0 | 396 | 94 | 111, 112 |
| ABD17818 | 3.00E−50 | 2.6.1.1 | 399 | 132 | 0 | 396 | 93 | 113, 114 |
| ABD17818 | 5.00E−52 | 2.6.1.1 | 393 | 130 | 0 | 396 | 96 | 115, 116 |
| ABD17818 | 5.00E−55 | 2.6.1.1 | 399 | 132 | 0 | 396 | 93 | 117, 118 |
| ABD17818 | 5.00E−55 | 2.6.1.1 | 399 | 132 | 0 | 396 | 93 | 119, 120 |
| ABD17818 | 3.00E−56 | 2.6.1.1 | 399 | 132 | 0 | 396 | 93 | 121, 122 |
| ABD17818 | 3.00E−38 | 2.6.1.1 | 399 | 132 | 0 | 396 | 93 | 123, 124 |
| ADS45796 | 0.038 | 2.6.1.42 | 831 | 276 | 0 | 273 | 57 | 125, 126 |
| ADH48029 | 1.00E−09 | 5.4.3.8 | 1362 | 453 | 0 | 455 | 55 | 127, 128 |
| ABL03211 | 2.4 | 2.6.1.21 | 864 | 287 | 0 | 285 | 57 | 129, 130 |
| ADP27941 | 0 | 2.6.1.21 | 855 | 284 | 1709 | 284 | | 131, 132 |
| ACL64145 | 0.16 | 2.6.1.21 | 876 | 291 | 0 | 285 | 45 | 133, 134 |
| ABL03211 | 2.4 | 2.6.1.21 | 864 | 287 | 0 | 285 | 57 | 135, 136 |
| AEC75821 | 0.001 | 5.4.3.8 | 1386 | 461 | 0 | 455 | 46 | 137, 138 |
| ADS57580 | 0.065 | 5.4.3.8 | 1383 | 460 | 0 | 455 | 43 | 139, 140 |

TABLE 3-continued

| | | | | | | | | |
|---|---|---|---|---|---|---|---|---|
| ABZ41029 | 0.15 | 2.6.1.21 | 855 | 284 | 0 | 286 | 51 | 141, 142 |
| AAS82939 | 0.66 | 2.6.1.21 | 915 | 304 | 0 | 285 | 57 | 143, 144 |
| ACL64704 | 0.99 | 5.4.3.8 | 1350 | 449 | 0 | 455 | 48 | 145, 146 |
| AAQ63611 | 2.00E−05 | 5.4.3.8 | 1383 | 460 | 0 | 454 | 44 | 147, 148 |
| ADS57112 | 0.004 | 5.4.3.8 | 1377 | 458 | 0 | 455 | 46 | 149, 150 |
| ADE53957 | 2.4 | 2.6.1.21 | 852 | 283 | 0 | 283 | 40 | 151, 152 |
| ACL64518 | 0.24 | 5.4.3.8 | 1269 | 422 | 0 | 455 | 46 | 153, 154 |
| ADT43944 | 3.00E−04 | 5.4.3.8 | 1362 | 453 | 0 | 443 | 46 | 155, 156 |
| ABQ42663 | 2.5 | 2.6.1.21 | 879 | 292 | 0 | 283 | 48 | 157, 158 |
| ACA38856 | 0.58 | 2.6.1.42 | 822 | 273 | 0 | 277 | 36 | 159, 160 |
| ADS56887 | 2.4 | 2.6.1.21 | 861 | 286 | 0 | 287 | 87 | 161, 162 |
| ACL64750 | 0.065 | 5.4.3.8 | 1377 | 458 | 0 | 455 | 44 | 163, 164 |
| ADS63519 | 7.00E−11 | 5.4.3.8 | 1314 | 437 | 0 | 455 | 46 | 165, 166 |
| ABL03988 | 2.4 | 2.6.1.21 | 861 | 286 | 0 | 282 | 60 | 167, 168 |
| ACA37578 | 2.00E−53 | 4.1.3.38 | 882 | 293 | 0 | 293 | 85 | 169, 170 |
| ABL03988 | 2.4 | 2.6.1.21 | 864 | 287 | 0 | 282 | 62 | 171, 172 |
| AED18099 | 0.039 | 2.6.1.21 | 861 | 286 | 0 | 282 | 62 | 173, 174 |
| AAF81809 | 0.61 | 2.6.1.21 | 861 | 286 | 0 | 282 | 62 | 175, 176 |
| ADM27081 | 0.004 | 5.4.3.8 | 1374 | 457 | 0 | 454 | 47 | 177, 178 |
| ADX27642 | 2.4 | 2.6.1.21 | 855 | 284 | 0 | 288 | 41 | 179, 180 |
| ABL61996 | 0.62 | 2.6.1.42 | 876 | 291 | 861 | 286 | 39 | 181, 182 |
| ADY80523 | 2.3 | 2.6.1.21 | 825 | 274 | 867 | 288 | 41 | 183, 184 |
| ADY80523 | 2.3 | 2.6.1.21 | 825 | 274 | 867 | 288 | 41 | 185, 186 |
| AAL04589 | 2.4 | 2.6.1.21 | 861 | 286 | 0 | 282 | 61 | 187, 188 |
| ABL25490 | 0.62 | 2.6.1.21 | 864 | 287 | 0 | 282 | 62 | 189, 190 |
| AAL04589 | 2.4 | 2.6.1.21 | 861 | 286 | 0 | 282 | 61 | 191, 192 |
| AAL04589 | 2.4 | 2.6.1.21 | 861 | 286 | 0 | 282 | 61 | 193, 194 |
| ADL41705 | 0.61 | 2.6.1.21 | 858 | 285 | 0 | 282 | 42 | 195, 196 |
| AEM18017 | 0.003 | 2.6.1.21 | 858 | 285 | 0 | 282 | 40 | 197, 198 |
| ABK78375 | 2.4 | 2.6.1.21 | 858 | 285 | 0 | 282 | 42 | 199, 200 |
| ACF67498 | 0.15 | 2.6.1.21 | 855 | 284 | 0 | 281 | 40 | 201, 202 |
| ACA40289 | 0.17 | 2.6.1.42 | 921 | 306 | 0 | 306 | 34 | 203, 204 |
| ADY80523 | 2.3 | 2.6.1.21 | 825 | 274 | 867 | 288 | 41 | 205, 206 |
| ABQ99281 | 0.15 | 2.6.1.21 | 825 | 274 | 867 | 288 | 40 | 207, 208 |
| ADH48029 | 0.001 | 5.4.3.8 | 1374 | 457 | 0 | 454 | 44 | 209, 210 |
| AAI92131 | 0.053 | 2.6.1.9 | 1137 | 378 | 0 | 367 | 29 | 211, 212 |
| ADX37088 | 0.6 | 2.6.1.21 | 849 | 282 | 0 | 282 | 61 | 213, 214 |
| ADS57580 | 0.004 | 5.4.3.8 | 1386 | 461 | 0 | 454 | 49 | 215, 216 |
| ADY80523 | 2.3 | 2.6.1.21 | 825 | 274 | 867 | 288 | 41 | 217, 218 |
| ABZ36033 | 0.16 | 2.6.1.21 | 861 | 286 | 0 | 282 | 62 | 219, 220 |
| ACN44196 | 2.3 | 2.6.1.21 | 840 | 279 | 0 | 281 | 43 | 221, 222 |
| AFB66287 | 0.62 | 2.6.1.21 | 867 | 288 | 867 | 288 | 60 | 223, 224 |
| AED18099 | 0.039 | 2.6.1.21 | 861 | 286 | 0 | 282 | 61 | 225, 226 |
| AED18099 | 0.61 | 2.6.1.21 | 861 | 286 | 0 | 282 | 62 | 227, 228 |
| AED18099 | 0.62 | 2.6.1.21 | 873 | 290 | 0 | 282 | 60 | 229, 230 |
| AED18099 | 0.62 | 2.6.1.21 | 864 | 287 | 0 | 282 | 61 | 231, 232 |
| ABL22310 | 0.58 | 2.6.1.42 | 822 | 273 | 0 | 277 | 35 | 233, 234 |
| ADT43796 | 0.65 | 2.6.1.42 | 906 | 301 | 1992 | 303 | | 235, 236 |
| AAI70509 | 2.3 | 2.6.1.21 | 837 | 278 | 0 | 294 | 44 | 237, 238 |
| AEM18017 | 0.038 | 2.6.1.21 | 843 | 280 | 870 | 282 | | 239, 240 |
| ADY80523 | 2.3 | 2.6.1.21 | 825 | 274 | 867 | 288 | 41 | 241, 242 |
| ADY80523 | 2.3 | 2.6.1.21 | 825 | 274 | 867 | 288 | 41 | 243, 244 |
| ADS56672 | 2.00E−28 | 2.6.1.57 | 909 | 302 | 0 | 398 | 90 | 245, 246 |
| ABA93421 | 0.61 | 2.6.1.21 | 861 | 286 | 0 | 282 | 62 | 247, 248 |
| ACL64761 | 0.15 | 2.6.1.42 | 837 | 278 | 0 | 280 | 34 | 249, 250 |
| ADQ03059 | 8.00E−04 | 1.4.99.1 | 138 | 45 | 0 | 417 | 93 | 251, 252 |
| ADA71348 | 0.92 | 1.4.99.1 | 1260 | 419 | 0 | 456 | 61 | 253, 254 |
| ACA26961 | 0.004 | 1.4.99.1 | 1233 | 410 | 0 | 410 | 84 | 255, 256 |
| ACL70702 | 0.058 | 1.4.99.1 | 1233 | 410 | 0 | 412 | 70 | 257, 258 |
| ABN17150 | 4.00E−12 | 1.4.99.1 | 1254 | 417 | 0 | 421 | 66 | 259, 260 |
| AEB45551 | 3.6 | 1... | 1248 | 415 | 0 | 417 | 65 | 261, 262 |
| AAV30459 | 1.00E−12 | 1.4.99.1 | 1254 | 417 | 1257 | 418 | 66 | 263, 264 |
| ADS63414 | 7.00E−22 | 1.5.1.5 | 747 | 248 | 0 | 287 | 79 | 265, 266 |
| AEH53102 | 0.001 | 1.4.99.1 | 1254 | 417 | 0 | 418 | 71 | 267, 268 |
| ABD08815 | 3.00E−90 | 1.4.99.1 | 1299 | 432 | 0 | 432 | 78 | 269, 270 |
| AAL40781 | 0.23 | 1.4.99.1 | 1239 | 412 | 0 | 414 | 59 | 271, 272 |
| ADY72597 | 0.23 | 1.4.99.1 | 1257 | 418 | 1251 | 416 | 48 | 273, 274 |
| ACL64753 | 0.92 | 1.4.99.1 | 1254 | 417 | 0 | 433 | 70 | 275, 276 |
| ABL23528 | 0.92 | 1.4.99.1 | 1254 | 417 | 0 | 433 | 69 | 277, 278 |
| ADS56371 | 3.6 | 1.4.99.1 | 1251 | 416 | 0 | 417 | 50 | 279, 280 |
| AEC16041 | 0.058 | 1.4.99.1 | 1242 | 413 | 0 | 416 | 63 | 281, 282 |
| ADQ03059 | 4.00E−12 | 1.4.99.1 | 1263 | 420 | 0 | 421 | 62 | 283, 284 |
| ABQ98347 | 3.7 | 1.4.99.1 | 1263 | 420 | 0 | 416 | 40 | 285, 286 |
| ABL11756 | 0.92 | 1.4.99.1 | 1257 | 418 | 0 | 416 | 52 | 287, 288 |
| ACL64803 | 0.06 | 1.4.99.1 | 1284 | 427 | 0 | 417 | 52 | 289, 290 |
| AEH54372 | 0.92 | 1.4.99.1 | 1263 | 420 | 0 | 416 | 56 | 291, 292 |
| ADT06724 | 0.23 | 1.4.99.1 | 1245 | 414 | 0 | 414 | 91 | 293, 294 |
| AAV06555 | 0.24 | 1.4.99.1 | 1296 | 431 | 0 | 427 | 42 | 295, 296 |
| ADA32153 | 3.6 | 1.4.99.1 | 1242 | 413 | 0 | 419 | 74 | 297, 298 |
| ADA32153 | 3.6 | 1.4.99.1 | 1242 | 413 | 0 | 419 | 74 | 299, 300 |

TABLE 3-continued

| | | | | | | | | |
|---|---|---|---|---|---|---|---|---|
| ABD16228 | 0.92 | 1... | 1254 | 417 | 0 | 415 | 66 | 301, 302 |
| AEH53102 | 0.059 | 1.4.99.1 | 1269 | 422 | 0 | 416 | 42 | 303, 304 |
| AEH53102 | 0 | 1.4.99.1 | 1299 | 432 | 0 | 434 | 93 | 305, 306 |
| ADR84929 | 0.24 | 1... | 1320 | 439 | 0 | 415 | 51 | 307, 308 |
| ADC87621 | 0.001 | 1.4.99.1 | 1242 | 413 | 0 | 427 | 44 | 309, 310 |
| ABD01189 | 3.00E−13 | 1.4.99.1 | 1266 | 421 | 0 | 421 | 95 | 311, 312 |
| ADS56475 | 3.6 | 1.4.99.1 | 1245 | 414 | 0 | 417 | 52 | 313, 314 |
| AAI99682 | 0.058 | 1.4.99.1 | 1236 | 411 | 0 | 414 | 60 | 315, 316 |
| ADZ00150 | 0.91 | 1.4.99.1 | 1245 | 414 | 0 | 416 | 43 | 317, 318 |
| ACA26563 | 0.052 | 1.1.1.35 | 1110 | 369 | 0 | 648 | 47 | 319, 320 |
| ACA26625 | 0.004 | 1.4.99.1 | 1248 | 415 | 0 | 416 | 68 | 321, 322 |
| ADS56305 | 0.015 | 1.4.99.1 | 1245 | 414 | 0 | 414 | 97 | 323, 324 |
| ABD08815 | ######## | 1.4.99.1 | 1302 | 433 | 0 | 434 | 98 | 325, 326 |
| ADT47109 | 0.059 | 1.4.99.1 | 1254 | 417 | 1251 | 416 | 49 | 327, 328 |
| ACA32282 | 0.91 | 1.4.99.1 | 1251 | 416 | 0 | 416 | 43 | 329, 330 |
| ABD01189 | 1.00E−09 | 1.4.99.1 | 1266 | 421 | 0 | 421 | 79 | 331, 332 |
| ACA26563 | 0.052 | 1.1.1.35 | 1110 | 369 | 0 | 648 | 47 | 333, 334 |
| ACA26625 | 0.004 | 1.4.99.1 | 1248 | 415 | 0 | 416 | 68 | 335, 336 |
| AEI59268 | 0.91 | 1.4.99.1 | 1248 | 415 | 0 | 417 | 49 | 337, 338 |
| ADC85461 | 0.91 | 1.4.99.1 | 1245 | 414 | 0 | 427 | 42 | 339, 340 |
| ACA26625 | 0.91 | 1.4.99.1 | 1248 | 415 | 0 | 416 | 68 | 341, 342 |
| ADS58499 | 0.008 | 1.1.1.184 | 693 | 230 | 0 | 228 | 48 | 343, 344 |
| ABN17150 | 4.00E−09 | 1.4.99.1 | 1260 | 419 | 0 | 427 | 43 | 345, 346 |
| ACL64399 | 0.23 | 1... | 1245 | 414 | 0 | 417 | 63 | 347, 348 |
| ACL64798 | 0.91 | 1.4.99.1 | 1251 | 416 | 0 | 417 | 51 | 349, 350 |
| ADT17628 | 0.92 | 1.4.99.1 | 1260 | 419 | 0 | 456 | 61 | 351, 352 |
| AED50859 | 0.059 | 1.4.99.1 | 1263 | 420 | 0 | 416 | 40 | 353, 354 |
| ADS56451 | 8.00E−07 | 1.2.1.39 | 1020 | 339 | 0 | 524 | 55 | 355, 356 |
| ABD32968 | 0.91 | 1.4.99.1 | 1251 | 416 | 0 | 427 | 40 | 357, 358 |
| ABD00632 | 0.23 | 1.4.99.1 | 1251 | 416 | 0 | 415 | 68 | 359, 360 |
| ABD00632 | 0.23 | 1.4.99.1 | 1251 | 416 | 0 | 415 | 68 | 361, 362 |
| ABD00632 | 0.23 | 1.4.99.1 | 1251 | 416 | 0 | 415 | 68 | 363, 364 |
| ABD01189 | 2.00E−11 | 1.4.99.1 | 1266 | 421 | 0 | 421 | 93 | 365, 366 |
| ABD01189 | 3.00E−07 | 1.4.99.1 | 1317 | 438 | 0 | 443 | 80 | 367, 368 |
| AEI27664 | 0.23 | 1.4.99.1 | 1245 | 414 | 0 | 427 | 44 | 369, 370 |
| AAV30459 | 1.00E−15 | 1.4.99.1 | 1266 | 421 | 0 | 421 | 94 | 371, 372 |
| ADS56859 | 0.23 | 1.4.99.1 | 1260 | 419 | 0 | 414 | 57 | 373, 374 |
| ADX06332 | 3.6 | 1.4.99.1 | 1257 | 418 | 0 | 415 | 43 | 375, 376 |
| AAK69489 | 0.23 | 1.4.99.1 | 1245 | 414 | 0 | 416 | 51 | 377, 378 |
| AED48875 | 0.015 | 1.4.99.1 | 1257 | 418 | 0 | 427 | 43 | 379, 380 |
| ABD00632 | 0.23 | 1.4.99.1 | 1251 | 416 | 0 | 415 | 68 | 381, 382 |
| ADQ03059 | 7.00E−11 | 1.4.99.1 | 1260 | 419 | 1257 | 418 | 88 | 383, 384 |
| ABA19863 | 0.91 | 1.4.99.1 | 1245 | 414 | 0 | 427 | 42 | 385, 386 |
| AAZ19073 | 0.91 | 1.4.99.1 | 1251 | 416 | 1251 | 416 | 75 | 387, 388 |
| ABD01189 | 2.00E−08 | 1.4.99.1 | 1317 | 438 | 0 | 443 | 80 | 389, 390 |
| ADB80216 | 0.92 | 1.4.99.1 | 1257 | 418 | 0 | 416 | 55 | 391, 392 |
| AEH53102 | 0.001 | 1.4.99.1 | 1257 | 418 | 0 | 416 | 51 | 393, 394 |
| ADX30055 | 0.058 | 1.4.99.1 | 1242 | 413 | 0 | 414 | 88 | 395, 396 |
| ADT43936 | 0.015 | 1.4.99.1 | 1245 | 414 | 0 | 417 | 52 | 397, 398 |
| ADL62778 | 0.23 | 1.4.99.1 | 1242 | 413 | 0 | 427 | 44 | 399, 400 |
| AAD06652 | 3.6 | 1.4.99.1 | 1260 | 419 | 0 | 427 | 33 | 401, 402 |
| ABQ80343 | 3.6 | 1.4.99.1 | 1257 | 418 | 0 | 427 | 47 | 403, 404 |
| ADW91994 | 0.91 | 1.4.99.1 | 1239 | 412 | 0 | 417 | 42 | 405, 406 |
| ABD01189 | 2.00E−11 | 1.4.99.1 | 1266 | 421 | 0 | 421 | 94 | 407, 408 |
| ADQ18897 | 0.92 | 1.4.99.1 | 1260 | 419 | 0 | 427 | 45 | 409, 410 |
| ADS55665 | 4.00E−09 | 1.2.1.4 | 1242 | 413 | 0 | 526 | 50 | 411, 412 |
| ACA25332 | 0.23 | 1.4.99.1 | 1248 | 415 | 0 | 417 | 52 | 413, 414 |
| ABL20166 | 0.015 | 1.4.99.1 | 1242 | 413 | 0 | 417 | 53 | 415, 416 |
| ACD81455 | 3.00E−10 | 1.4.99.1 | 1248 | 415 | 1257 | 418 | 73 | 417, 418 |
| ADQ03059 | 2.00E−05 | 1.4.99.1 | 1326 | 441 | 0 | 445 | 76 | 419, 420 |
| ACA37735 | 0.24 | 1.4.99.1 | 1293 | 430 | 0 | 419 | 49 | 421, 422 |
| ABL70446 | 0.91 | 1.4.99.1 | 1245 | 414 | 0 | 427 | 43 | 423, 424 |
| ADJ44795 | 0.92 | 1.4.99.1 | 1260 | 419 | 0 | 416 | 53 | 425, 426 |
| ADS57588 | 0.92 | 1.4.99.1 | 1254 | 417 | 0 | 433 | 72 | 427, 428 |
| AAT42063 | 0.059 | 1.4.99.1 | 1263 | 420 | 0 | 427 | 44 | 429, 430 |
| ADF77343 | 0.91 | 1.4.99.1 | 1242 | 413 | 0 | 427 | 49 | 431, 432 |
| AEF68383 | 0.23 | 1.4.99.1 | 1245 | 414 | 0 | 417 | 52 | 433, 434 |
| ADB80390 | 0.92 | 1.4.99.1 | 1254 | 417 | 0 | 417 | 51 | 435, 436 |
| ACL28407 | 1.2 | 1.2.99.2 | 453 | 150 | 0 | 150 | 84 | 437, 438 |
| ADS63732 | 2.2 | | 780 | 259 | 0 | 260 | 64 | 439, 440 |
| AEB49411 | 0.22 | | 1182 | 393 | 0 | 393 | 76 | 441, 442 |
| ACA26463 | 0.06 | 1... | 1272 | 423 | 0 | 417 | 61 | 443, 444 |
| AEK18770 | 0.015 | 1.4.99.1 | 1245 | 414 | 0 | 415 | 69 | 445, 446 |
| ABD08815 | 4.00E−37 | 1.4.99.1 | 1308 | 435 | 0 | 434 | 84 | 447, 448 |
| ABD03414 | 0.015 | 1.4.99.1 | 1248 | 415 | 0 | 416 | 48 | 449, 450 |
| ACA23380 | 0.23 | 1... | 1245 | 414 | 0 | 416 | 62 | 451, 452 |
| ABN24675 | 0.92 | 1... | 1254 | 417 | 0 | 417 | 53 | 453, 454 |
| ACA64961 | 0.91 | 1.4.99.1 | 1242 | 413 | 0 | 427 | 45 | 455, 456 |
| ABL10568 | 0.23 | 1.4.99.1 | 1251 | 416 | 0 | 416 | 68 | 457, 458 |
| ABL12550 | 3.7 | 1.4.99.1 | 1266 | 421 | 0 | 410 | 78 | 459, 460 |

TABLE 3-continued

| | | | | | | | | |
|---|---|---|---|---|---|---|---|---|
| ACH99914 | 6.00E−04 | 1... | 762 | 253 | 0 | 254 | 76 | 461, 462 |
| ADQ64455 | 0.23 | 1.4.99.1 | 1248 | 415 | 0 | 415 | 69 | 463, 464 |
| AAC90078 | 8.00E−05 | 1.1.1.95 | 447 | 148 | 0 | 334 | 34 | 465, 466 |
| AEI59858 | 0.23 | 1.4.99.1 | 1242 | 413 | 0 | 414 | 55 | 467, 468 |
| ADZ13449 | 0.91 | 1... | 1245 | 414 | 0 | 415 | 66 | 469, 470 |
| AAS77111 | 0 | 1.4.99.1 | 1299 | 432 | 0 | 434 | 100 | 471, 472 |
| ACF04822 | 0.91 | 1... | 1248 | 415 | 0 | 417 | 64 | 473, 474 |
| ADN97550 | 0.25 | 1.4.99.1 | 1341 | 446 | 0 | 427 | 62 | 475, 476 |
| ACN44608 | 0.001 | 1.4.99.1 | 1239 | 412 | 0 | 416 | 38 | 477, 478 |
| ACN44608 | 0.001 | 1.4.99.1 | 1239 | 412 | 0 | 416 | 38 | 479, 480 |
| ADF69167 | 0.059 | 1.4.99.1 | 1251 | 416 | 0 | 416 | 69 | 481, 482 |
| ABD08815 | 0.001 | 1.4.99.1 | 1311 | 436 | 0 | 443 | 82 | 483, 484 |
| ABN17150 | 2.00E−11 | 1.4.99.1 | 1269 | 422 | 0 | 421 | 67 | 485, 486 |
| ADI37347 | 3.7 | 1... | 1263 | 420 | 0 | 417 | 53 | 487, 488 |
| ADS57628 | 0.91 | 1.4.99.1 | 1242 | 413 | 0 | 417 | 54 | 489, 490 |
| ACA26589 | 0.015 | 1.4.99.1 | 1290 | 429 | 0 | 427 | 41 | 491, 492 |
| ADO81756 | 0.063 | 1.4.99.1 | 1344 | 447 | 0 | 427 | 41 | 493, 494 |
| ADO81304 | 0.92 | 1.4.99.1 | 1254 | 417 | 0 | 417 | 49 | 495, 496 |
| ABL27820 | 3.7 | 1... | 1263 | 420 | 0 | 417 | 53 | 497, 498 |
| AAL04340 | 0.91 | 1.4.99.1 | 1245 | 414 | 0 | 417 | 49 | 499, 500 |
| AAF71906 | 0.11 | 1.5.1.12 | 2334 | 777 | 0 | 1158 | 48 | 501, 502 |
| ADS59567 | 0.015 | 1.4.99.1 | 1263 | 420 | 0 | 416 | 49 | 503, 504 |
| ACF64502 | 0.93 | 1.4.99.1 | 1266 | 421 | 0 | 416 | 50 | 505, 506 |
| ACL63896 | 0.059 | 1.4.99.1 | 1254 | 417 | 0 | 433 | 71 | 507, 508 |
| ADP48960 | 3.6 | 1.4.99.1 | 1245 | 414 | 0 | 417 | 49 | 509, 510 |
| ACH97397 | 0.015 | 1.4.99.1 | 1266 | 421 | 0 | 414 | 65 | 511, 512 |
| ACA35076 | 2.00E−04 | 1.4.99.1 | 1269 | 422 | 0 | 443 | 77 | 513, 514 |
| AEF51726 | 0.91 | 1.4.99.1 | 1242 | 413 | 0 | 419 | 74 | 515, 516 |
| ACA63029 | 0.058 | 1.4.99.1 | 1239 | 412 | 0 | 415 | 48 | 517, 518 |
| AAX91990 | 0.015 | 1.4.99.1 | 1251 | 416 | 0 | 416 | 43 | 519, 520 |
| ABK13581 | 0.015 | 1.4.99.1 | 1254 | 417 | 0 | 415 | 79 | 521, 522 |
| ACN44966 | 0.23 | 1.4.99.1 | 1245 | 414 | 0 | 415 | 40 | 523, 524 |
| AAA58472 | 0.91 | 1... | 1242 | 413 | 0 | 416 | 61 | 525, 526 |
| ADS59863 | 0.058 | 1... | 1248 | 415 | 0 | 415 | 78 | 527, 528 |
| ADZ14743 | 0.058 | 1.4.99.1 | 1245 | 414 | 0 | 433 | 53 | 529, 530 |
| ABD17880 | 0.001 | 1.4.99.1 | 1257 | 418 | 0 | 429 | 59 | 531, 532 |
| ACA35414 | 0.93 | 1.4.99.1 | 1269 | 422 | 0 | 416 | 40 | 533, 534 |
| ADS55665 | 1.00E−12 | 1.2.1. | 1581 | 526 | 0 | 525 | 52 | 535, 536 |
| ABN88913 | 3.6 | 1.4.99.1 | 1260 | 419 | 0 | 414 | 57 | 537, 538 |
| ABD17784 | 0.058 | 1.4.99.1 | 1242 | 413 | 0 | 413 | 96 | 539, 540 |
| ABQ90794 | 0.059 | 1.4.99.1 | 1266 | 421 | 1251 | 416 | 57 | 541, 542 |
| ADF77343 | 3.6 | 1.4.99.1 | 1248 | 415 | 0 | 427 | 45 | 543, 544 |
| AAC41739 | 0.24 | 1.4.99.1 | 1296 | 431 | 0 | 417 | 50 | 545, 546 |
| ADS50144 | 0.93 | 1.4.99.1 | 1266 | 421 | 0 | 416 | 39 | 547, 548 |
| AAL13181 | 2.00E−04 | 1.4.99.1 | 1254 | 417 | 0 | 429 | 59 | 549, 550 |
| ACF64460 | 0.003 | 1.5.1.12 | 3306 | 1101 | 0 | 1158 | 49 | 551, 552 |
| ADO81304 | 0.92 | 1.4.99.1 | 1254 | 417 | 0 | 417 | 49 | 553, 554 |
| ADZ14743 | 0.058 | 1.4.99.1 | 1242 | 413 | 0 | 433 | 53 | 555, 556 |
| ACN44650 | 0.23 | 1... | 1260 | 419 | 0 | 417 | 55 | 557, 558 |
| ACN44650 | 0.23 | 1... | 1260 | 419 | 0 | 417 | 55 | 559, 560 |
| ACL64800 | 2.00E−05 | 1.6.99.3 | 1230 | 409 | 1293 | 430 | 62 | 561, 562 |
| AAA55186 | 5.00E−04 | 1.1.1.100 | 720 | 239 | 0 | 270 | 56 | 563, 564 |
| ADO81304 | 0.92 | 1.4.99.1 | 1254 | 417 | 0 | 417 | 49 | 565, 566 |
| ACH97385 | 0.016 | 1.4.99.1 | 1344 | 447 | 0 | 444 | 69 | 567, 568 |
| ABX92073 | 0.92 | 1.4.99.1 | 1260 | 419 | 0 | 427 | 42 | 569, 570 |
| ABD01189 | 3.00E−13 | 1.4.99.1 | 1248 | 415 | 1257 | 418 | 76 | 571, 572 |
| ACA26568 | 0.059 | 1.4.99.1 | 1263 | 420 | 0 | 417 | 39 | 573, 574 |
| ADS56451 | 2.00E−08 | 1.2.1. | 1584 | 527 | 0 | 530 | 53 | 575, 576 |
| ACL64632 | 0.91 | 1... | 1242 | 413 | 0 | 415 | 67 | 577, 578 |
| AAV30459 | 7.00E−51 | 1.4.99.1 | 1254 | 417 | 0 | 422 | 83 | 579, 580 |
| AEG64174 | 0.92 | 1.4.99.1 | 1260 | 419 | 0 | 414 | 57 | 581, 582 |
| ABD13052 | 3.6 | 1.4.99.1 | 1233 | 410 | 0 | 410 | 83 | 583, 584 |
| ABD01189 | 3.00E−04 | 1.4.99.1 | 1338 | 445 | 0 | 455 | 81 | 585, 586 |
| ABL10910 | 0.24 | 1.4.99.1 | 1290 | 429 | 0 | 414 | 57 | 587, 588 |
| ACL64760 | 0.92 | 1.4.99.1 | 1254 | 417 | 0 | 415 | 78 | 589, 590 |
| ADX35599 | 0.015 | 1... | 1245 | 414 | 0 | 417 | 59 | 591, 592 |
| ACA26173 | 0.015 | 1.4.99.1 | 1272 | 423 | 0 | 417 | 50 | 593, 594 |
| ADS55748 | 0.015 | 1.4.99.1 | 1257 | 418 | 0 | 433 | 73 | 595, 596 |
| AEH53102 | 3.00E−19 | 1.4.99.1 | 1317 | 438 | 0 | 435 | 71 | 597, 598 |
| AAV30459 | 1.00E−61 | 1.4.99.1 | 1251 | 416 | 0 | 422 | 84 | 599, 600 |
| AAV30459 | 2.00E−60 | 1.4.99.1 | 1254 | 417 | 0 | 422 | 81 | 601, 602 |
| ABX86147 | 0.23 | 1.4.99.1 | 1254 | 417 | 0 | 416 | 42 | 603, 604 |
| ADS56578 | 0.92 | 1... | 1254 | 417 | 0 | 417 | 67 | 605, 606 |
| ADZ49334 | 0.91 | 1.4.99.1 | 1251 | 416 | 0 | 429 | 51 | 607, 608 |
| ADT18820 | 0.004 | 1... | 1233 | 410 | 0 | 416 | 61 | 609, 610 |
| AAV30459 | 7.00E−51 | 1.4.99.1 | 1254 | 417 | 0 | 422 | 83 | 611, 612 |
| ABQ66079 | 0.24 | 1.4.99.1 | 1287 | 428 | 0 | 423 | 43 | 613, 614 |
| ACL64301 | 0.91 | 1... | 1248 | 415 | 0 | 415 | 79 | 615, 616 |
| ADX64511 | 0.015 | 1.4.99.1 | 1245 | 414 | 0 | 417 | 49 | 617, 618 |
| ADS55665 | 1.00E−12 | 1.2.1.39 | 1593 | 530 | 0 | 526 | 51 | 619, 620 |

TABLE 3-continued

| | | | | | | | | |
|---|---|---|---|---|---|---|---|---|
| ABQ81842 | 0.059 | 1.4.99.1 | 1266 | 421 | 0 | 416 | 42 | 621, 622 |
| ABD08815 | 3.00E−07 | 1.4.99.1 | 1260 | 419 | 0 | 436 | 55 | 623, 624 |
| ADQ03059 | 4.00E−09 | 1.4.99.1 | 1254 | 417 | 0 | 416 | 79 | 625, 626 |
| ADQ03059 | 0.059 | 1.4.99.1 | 1257 | 418 | 0 | 429 | 60 | 627, 628 |
| ADQ74672 | 0.17 | 1... | 921 | 306 | 74787 | 305 | | 629, 630 |
| ACL30152 | 0.015 | 1.4.99.1 | 1233 | 410 | 0 | 465 | 86 | 631, 632 |
| ABD08815 | 8.00E−23 | 1.4.99.1 | 1293 | 430 | 0 | 432 | 74 | 633, 634 |
| ABD08815 | 2.00E−32 | 1.4.99.1 | 1296 | 431 | 0 | 432 | 76 | 635, 636 |
| ABD05088 | 2.00E−66 | 1.1.99. | 1128 | 375 | 0 | 375 | 87 | 637, 638 |
| ACA27410 | 0.18 | 1.1.1. | 1002 | 333 | 0 | 345 | 44 | 639, 640 |
| ABD05088 | 2.00E−66 | 1.1.99. | 1128 | 375 | 0 | 375 | 87 | 641, 642 |
| ABN17150 | 0.059 | 1.4.99.1 | 1266 | 421 | 0 | 422 | 42 | 643, 644 |
| AEM45684 | 0.23 | 1... | 1245 | 414 | 0 | 414 | 62 | 645, 646 |
| ABD08815 | 4.00E−06 | 1.4.99.1 | 1296 | 431 | 0 | 428 | 65 | 647, 648 |
| ABD05284 | 0.058 | 1.4.99.1 | 1245 | 414 | 0 | 414 | 61 | 649, 650 |
| ACA27392 | 0.058 | 1.4.99.1 | 1236 | 411 | 0 | 410 | 53 | 651, 652 |
| ACA36215 | 1.00E−15 | 1.8.1.7 | 1344 | 447 | 0 | 456 | 55 | 653, 654 |
| ACF04822 | 0.94 | 1.4.99.1 | 1284 | 427 | 0 | 417 | 48 | 655, 656 |
| AAD55815 | 2.9 | 1.4.3.3 | 1008 | 335 | 0 | 314 | 45 | 657, 658 |
| AAL13181 | 0.001 | 1.4.99.1 | 1245 | 414 | 0 | 418 | 62 | 659, 660 |
| ADJ40271 | 0.056 | | 1188 | 395 | 0 | 404 | 50 | 661, 662 |
| ADX45957 | 0.058 | 1.4.99.1 | 1245 | 414 | 0 | 417 | 52 | 663, 664 |
| ABT17713 | 0.92 | 1.4.99.1 | 1263 | 420 | 0 | 423 | 41 | 665, 666 |
| AAS83512 | 0.81 | 1.4.3.1 | 1113 | 370 | 0 | 377 | 45 | 667, 668 |
| AAV21187 | 0.92 | 1.4.99.1 | 1260 | 419 | 0 | 417 | 52 | 669, 670 |
| ABQ19293 | 3.6 | 1.4.99.1 | 1242 | 413 | 0 | 413 | 82 | 671, 672 |
| ABQ19293 | 3.6 | 1.4.99.1 | 1242 | 413 | 0 | 413 | 82 | 673, 674 |
| ABQ19293 | 3.6 | 1.4.99.1 | 1242 | 413 | 0 | 413 | 82 | 675, 676 |
| ACA45556 | 0.65 | 1.4.3.3 | 909 | 302 | 0 | 310 | 42 | 677, 678 |
| ABD04986 | 4.00E−09 | 1.1.99. | 1161 | 386 | 0 | 385 | 83 | 679, 680 |
| ADC76718 | 0.93 | 1.4.99.1 | 1266 | 421 | 0 | 423 | 43 | 681, 682 |
| AAF71130 | 0.059 | 1.4.99.1 | 1251 | 416 | 0 | 421 | 42 | 683, 684 |
| ABT07579 | 0.06 | 1.4.99.1 | 1281 | 426 | 0 | 421 | 40 | 685, 686 |
| ADS56436 | 0.044 | 1.4.3.3 | 957 | 318 | 0 | 314 | 44 | 687, 688 |
| ADX50476 | 0.23 | 1.4.99.1 | 1248 | 415 | 0 | 548 | 64 | 689, 690 |
| AAA81470 | 0.058 | 1.4.99.1 | 1239 | 412 | 0 | 422 | 66 | 691, 692 |
| ACA34135 | 3.9 | 1.6.99.3 | 396 | 131 | 0 | 132 | 73 | 693, 694 |
| ABD05088 | 1.00E−12 | 1.1.99. | 1164 | 387 | 0 | 388 | 63 | 695, 696 |
| ADT43170 | 0.001 | 1.4.99.1 | 1257 | 418 | 0 | 422 | 47 | 697, 698 |
| ACA26065 | 0.015 | 1.4.99.1 | 1245 | 414 | 0 | 417 | 52 | 699, 700 |
| ABL13112 | 0.18 | 1.4.3.3 | 981 | 326 | 0 | 314 | 39 | 701, 702 |
| ADM27081 | 0.23 | 1.4.99.1 | 1248 | 415 | 0 | 417 | 50 | 703, 704 |
| ABD08105 | 0.23 | 1.4.99.1 | 1233 | 410 | 0 | 410 | 56 | 705, 706 |
| ADY66589 | 0.06 | 1.4.99.1 | 1275 | 424 | 0 | 417 | 52 | 707, 708 |
| ADT43021 | 0.23 | 1.4.99.1 | 1233 | 410 | 0 | 410 | 75 | 709, 710 |
| ADA48957 | 0.23 | 1.4.99.1 | 1266 | 421 | 0 | 421 | 43 | 711, 712 |
| ADT43021 | 0.23 | 1.4.99.1 | 1233 | 410 | 0 | 410 | 75 | 713, 714 |
| AET00128 | 0.91 | 1.4.99.1 | 1251 | 416 | 0 | 420 | 43 | 715, 716 |
| | 0 | | 912 | 303 | 0 | 358 | 29 | 717, 718 |
| ABD10326 | 3.6 | 1.4.99.1 | 1251 | 416 | 0 | 417 | 57 | 719, 720 |
| ADT44787 | 0.042 | 1.4.3.3 | 918 | 305 | 0 | 310 | 42 | 721, 722 |
| AAL13181 | 0.001 | 1.4.99.1 | 1251 | 416 | 0 | 423 | 41 | 723, 724 |
| ABN17150 | 1.00E−12 | 1.4.99.1 | 1260 | 419 | 0 | 418 | 56 | 725, 726 |
| ABL15242 | 3.9 | 1.4.99.1 | 1329 | 442 | 0 | 423 | 56 | 727, 728 |
| ABD01828 | 0.051 | 1.2.7.3 | 1098 | 365 | 0 | 576 | 65 | 729, 730 |
| AAL13181 | 1.00E−06 | 1.4.99.1 | 1260 | 419 | 0 | 420 | 41 | 731, 732 |
| ADS63429 | 0.23 | 1.4.99.1 | 1257 | 418 | 0 | 420 | 44 | 733, 734 |
| ACL64584 | 2.00E−06 | 1.1.2.4 | 807 | 268 | 0 | 477 | 48 | 735, 736 |
| ABD10634 | 0.058 | 1.4.99.1 | 1242 | 413 | 0 | 414 | 62 | 737, 738 |
| AAD07816 | 0.91 | 1... | 1245 | 414 | 0 | 414 | 63 | 739, 740 |
| AAD07816 | 0.91 | 1... | 1245 | 414 | 0 | 414 | 63 | 741, 742 |
| ABD10634 | 0.058 | 1.4.99.1 | 1242 | 413 | 0 | 414 | 62 | 743, 744 |
| AER28868 | 0.83 | 1.1.99. | 1146 | 381 | 0 | 385 | 49 | 745, 746 |
| ABD08815 | 0.015 | 1.4.99.1 | 1278 | 425 | 0 | 462 | 53 | 747, 748 |
| AAL13181 | 2.00E−07 | 1.4.99.1 | 1245 | 414 | 0 | 418 | 60 | 749, 750 |
| ACA23297 | 0.65 | 1.14.13. | 915 | 304 | 0 | 543 | 49 | 751, 752 |
| ADD01267 | 0.23 | 1.4.99.1 | 1248 | 415 | 0 | 417 | 52 | 753, 754 |
| | 0 | 1.4.99.1 | 1245 | 414 | 0 | 417 | 51 | 755, 756 |
| ADJ09909 | 3.6 | 1.4.99.1 | 1251 | 416 | 0 | 410 | 55 | 757, 758 |
| AEH18256 | 0.23 | 1.4.99.1 | 1254 | 417 | 0 | 417 | 49 | 759, 760 |
| ADR47152 | 0.23 | 1.4.99.1 | 1242 | 413 | 0 | 414 | 62 | 761, 762 |
| AAL13181 | 0.001 | 1.4.99.1 | 1251 | 416 | 0 | 421 | 41 | 763, 764 |
| ADS59768 | 9.00E−07 | 1.1.2.4 | 1182 | 393 | 0 | 477 | 51 | 765, 766 |
| AAL13181 | 0.015 | 1.4.99.1 | 1257 | 418 | 0 | 421 | 41 | 767, 768 |
| ACA37735 | 0.015 | 1.4.99.1 | 1242 | 413 | 0 | 414 | 62 | 769, 770 |
| ABD14131 | 0.91 | 1.4.99.1 | 1245 | 414 | 0 | 417 | 53 | 771, 772 |
| ADR47152 | 0.23 | 1.4.99.1 | 1242 | 413 | 0 | 414 | 62 | 773, 774 |
| ABT17832 | 3.7 | 1.4.99.1 | 1272 | 423 | 0 | 423 | 38 | 775, 776 |
| ACA26366 | 0.9 | 1.4.99.1 | 1233 | 410 | 0 | 410 | 92 | 777, 778 |
| ACL30152 | 0.23 | 1.4.99.1 | 1233 | 410 | 0 | 465 | 86 | 779, 780 |

TABLE 3-continued

| | | | | | | | | |
|---|---|---|---|---|---|---|---|---|
| AEA26962 | 0.06 | 1.4.99.1 | 1272 | 423 | 0 | 422 | 52 | 781, 782 |
| ADT42301 | 9.00E−10 | 1.1.2.4 | 1137 | 378 | 0 | 477 | 51 | 783, 784 |
| ABD08815 | 0.001 | 1.4.99.1 | 1251 | 416 | 0 | 421 | 41 | 785, 786 |
| AAL13181 | 0.001 | 1.4.99.1 | 1251 | 416 | 0 | 420 | 42 | 787, 788 |
| ACA39870 | 0.23 | 1.4.99.1 | 1248 | 415 | 0 | 410 | 46 | 789, 790 |
| ADQ24247 | 3 | 1.3.1.26 | 1044 | 347 | 0 | 333 | 50 | 791, 792 |
| ADT18820 | 0.004 | 1... | 1233 | 410 | 1254 | 417 | 63 | 793, 794 |
| AEM45684 | 0.007 | 1.2.7.8 | 2313 | 770 | 0 | 1173 | 61 | 795, 796 |
| ADT47055 | 1.00E−06 | 1.1.2.4 | 1437 | 478 | 0 | 477 | 53 | 797, 798 |
| ACH13524 | 0.015 | 1.4.99.1 | 1281 | 426 | 0 | 421 | 42 | 799, 800 |
| ADS63429 | 0.23 | 1.4.99.1 | 1257 | 418 | 0 | 420 | 44 | 801, 802 |
| ADJ41976 | 0.92 | 1.4.99.1 | 1257 | 418 | 0 | 421 | 42 | 803, 804 |
| ABZ40619 | 4.00E−09 | 1.1.2.4 | 1323 | 440 | 0 | 477 | 53 | 805, 806 |
| AAF66669 | 0.25 | 1.4.99.1 | 1329 | 442 | 0 | 423 | 55 | 807, 808 |
| ABQ81849 | 0.91 | 1.4.99.1 | 1242 | 413 | 0 | 413 | 81 | 809, 810 |
| ABQ81849 | 0.91 | 1.4.99.1 | 1242 | 413 | 0 | 413 | 81 | 811, 812 |
| ABQ81849 | 0.91 | 1.4.99.1 | 1242 | 413 | 0 | 413 | 81 | 813, 814 |
| ABQ81849 | 0.91 | 1.4.99.1 | 1242 | 413 | 0 | 413 | 81 | 815, 816 |
| AEH53102 | 0.004 | 1.4.99.1 | 1269 | 422 | 0 | 421 | 43 | 817, 818 |
| ABN17150 | 0.015 | 1.4.99.1 | 1263 | 420 | 0 | 420 | 54 | 819, 820 |
| ABD10634 | 0.058 | 1.4.99.1 | 1242 | 413 | 0 | 414 | 62 | 821, 822 |
| AAV72125 | 2.00E−04 | 1.5.3.1 | 1170 | 389 | 1167 | 388 | 77 | 823, 824 |
| ABD04986 | 1.00E−12 | 1.1.99. | 1146 | 381 | 0 | 385 | 90 | 825, 826 |
| AEA26962 | 0.06 | 1.4.99.1 | 1272 | 423 | 0 | 422 | 52 | 827, 828 |
| ABD08815 | 6.00E−05 | 1.4.99.1 | 1281 | 426 | 0 | 421 | 40 | 829, 830 |
| ABD04986 | 2.00E−11 | 1.1.99. | 1137 | 378 | 1152 | 383 | 49 | 831, 832 |
| ADS63429 | 0.23 | 1.4.99.1 | 1257 | 418 | 0 | 420 | 44 | 833, 834 |
| ADS56646 | 8.00E−14 | 1.1.2.4 | 1395 | 464 | 0 | 477 | 52 | 835, 836 |
| AEK59509 | 0.68 | 1.4.3.1 | 942 | 313 | 0 | 314 | 39 | 837, 838 |
| ABQ81849 | 0.91 | 1.4.99.1 | 1242 | 413 | 0 | 413 | 81 | 839, 840 |
| ABN17150 | 2.00E−05 | 1.4.99.1 | 1269 | 422 | 0 | 418 | 52 | 841, 842 |
| ABD08815 | 1.00E−43 | 1.4.99.1 | 1290 | 429 | 0 | 428 | 72 | 843, 844 |
| AAD56788 | 0.23 | 1.4.99.1 | 1233 | 410 | 0 | 410 | 93 | 845, 846 |
| ABD05088 | 2.00E−51 | 1.1.99. | 1131 | 376 | 0 | 375 | 77 | 847, 848 |
| AEH53102 | 0.004 | 1.4.99.1 | 1269 | 422 | 0 | 421 | 43 | 849, 850 |
| AAI99682 | 0.18 | 1.4.3.3 | 975 | 324 | 4.00E+06 | 326 | | 851, 852 |
| ABD05088 | 2.00E−51 | 1.1.99. | 1131 | 376 | 0 | 375 | 77 | 853, 854 |
| ABD04986 | 1.00E−05 | 1.1.99. | 1173 | 390 | 0 | 390 | 99 | 855, 856 |
| ABD04986 | 1.00E−05 | 1.1.99. | 1173 | 390 | 0 | 390 | 99 | 857, 858 |
| ABD04986 | 1.00E−05 | 1.1.99. | 1173 | 390 | 0 | 390 | 99 | 859, 860 |
| AED11687 | 5.00E−08 | 1.4.3.3 | 987 | 328 | 0 | 326 | 46 | 861, 862 |
| ABD08815 | 0 | 1.4.99.1 | 1299 | 432 | 0 | 433 | 88 | 863, 864 |
| | 2.7 | 2.6.1.21 | 861 | 286 | 690 | 282 | 37 | 865, 866 |
| | 0.003 | 2.6.1.9 | 1062 | 353 | 12392 | 373 | 30 | 867, 868 |
| | 2.00E−25 | 2.6.1.21 | 852 | 283 | 1140 | 283 | 78 | 869, 870 |
| | 1.1 | 5.4.3.8 | 1350 | 449 | 3784 | 417 | 46 | 871, 872 |
| | 0.071 | 5.4.3.8 | 1401 | 466 | 1358 | 417 | 44 | 873, 874 |
| | 1.00E−09 | 5.4.3.8 | 1344 | 447 | 37500 | 417 | 48 | 875, 876 |
| | 0.018 | 5.4.3.8 | 1389 | 462 | 231 | 417 | 43 | 877, 878 |
| | 0.018 | 5.4.3.8 | 1398 | 465 | 1356 | 417 | 43 | 879, 880 |
| | 2.7 | 2.6.1.21 | 873 | 290 | 1653 | 282 | 39 | 881, 882 |
| | | 2.6.1.21 | | 292 | | 283 | 42 | 883, 884 |
| | 2.7 | 2.6.1.21 | 861 | 286 | 19976 | 283 | 40 | 885, 886 |
| | 0.63 | 2.6.1.42 | 801 | 266 | 799 | 284 | 37 | 887, 888 |
| | 0.66 | 2.6.1.21 | 840 | 279 | 264 | 282 | 41 | 889, 890 |
| | 0.67 | 2.6.1.21 | 861 | 286 | 599 | 283 | 39 | 891, 892 |
| | 0.17 | 2.6.1.21 | 861 | 286 | 44577 | 283 | 37 | 893, 894 |
| | 0.66 | 2.6.1.21 | 849 | 282 | 16714 | 289 | 39 | 895, 896 |
| | 7.00E−08 | 5.4.3.8 | 1353 | 450 | 1287 | 417 | 47 | 897, 898 |
| | 1.00E−09 | 5.4.3.8 | 1362 | 453 | 37500 | 417 | 47 | 899, 900 |
| | 0.001 | 5.4.3.8 | 1386 | 461 | 1341 | 417 | 49 | 901, 902 |
| | 0.07 | 5.4.3.8 | 1383 | 460 | 870 | 417 | 47 | 903, 904 |
| | 2.7 | 2.6.1.21 | 864 | 287 | 5766 | 298 | 46 | 905, 906 |
| | 0.042 | 2.6.1.42 | 831 | 276 | 591 | 284 | 36 | 907, 908 |
| | 0 | 2.6.1.21 | 855 | 284 | 1709 | 284 | 97 | 909, 910 |
| | 0.17 | 2.6.1.21 | 876 | 291 | 4862 | 278 | 36 | 911, 912 |
| | 2.6 | 2.6.1.21 | 852 | 283 | 7166 | 282 | 43 | 913, 914 |
| | 2.00E−05 | 5.4.3.8 | 1383 | 460 | 1701 | 417 | 41 | 915, 916 |
| | 0.72 | 2.6.1.21 | 915 | 304 | 652 | 282 | 39 | 917, 918 |
| | 1.1 | 5.4.3.8 | 1350 | 449 | 18471 | 417 | 46 | 919, 920 |
| | 0.07 | 5.4.3.8 | 1377 | 458 | 20250 | 417 | 48 | 921, 922 |
| | 2.7 | 2.6.1.21 | 861 | 286 | 864 | 298 | 50 | 923, 924 |
| | 0.004 | 5.4.3.8 | 1377 | 458 | 1251 | 417 | 44 | 925, 926 |
| | 0 | 2.6.1.1 | 1185 | 394 | 1185 | 394 | 100 | 927, 928 |
| | | 2.6.1.42 | | 322 | | 317 | 100 | 929, 930 |
| | | 2.6.1.62 | | 519 | | 461 | 100 | 931, 932 |
| | 3.8 | 2.6.1.1 | 1206 | 401 | 9502 | 387 | 33 | 933, 934 |
| | 0 | 2.6.1.62 | 1383 | 460 | 1383 | 460 | 100 | 935, 936 |
| | 2.6 | 2.6.1.21 | 855 | 284 | 2000 | 298 | 48 | 937, 938 |
| | 0.67 | 2.6.1.21 | 855 | 284 | 86941 | 298 | 39 | 939, 940 |

TABLE 3-continued

|  | | | | | | | | |
|---|---|---|---|---|---|---|---|---|
|  | 2.7 | 2.6.1.21 | 879 | 292 | 2840 | 298 | 41 | 941, 942 |
|  | 0.17 | 2.6.1.21 | 870 | 289 | 1899 | 283 | 40 | 943, 944 |
|  | 0.011 | 2.6.1.21 | 855 | 284 | 636 | 283 | 39 | 945, 946 |
|  | 0.042 | 2.6.1.21 | 837 | 278 | 897 | 282 | 40 | 947, 948 |
|  |  | 2.6.1.42 |  | 305 |  | 310 | 33 | 949, 950 |
| AAS46730 | 3.6 | 2.6.1.1 | 1206 | 401 | 9502 | 387 |  | 951, 952 |
| ADS45406 | 0 | 2.6.1.1 | 1185 | 394 | 0 | 394 | 100 | 953, 954 |
| ADS78244 | 0 | 2.6.1.42 | 879 | 292 | 954 | 317 |  | 955, 956 |
| ADS78324 | 0 | 2.6.1.62 | 1386 | 461 | 0 | 460 | 72 | 957, 958 |
| ADS78290 | 0 | 2.6.1.62 | 1383 | 460 | 1383 | 460 |  | 959, 960 |

The invention provides variants of polynucleotides or polypeptides of the invention, which comprise sequences modified at one or more base pairs, codons, introns, exons, or amino acid residues (respectively) yet still retain the biological activity of a transferase, e.g., a transaminase, e.g., a d-amino-acid transferase, and/or an oxidoreductase, e.g., a dehydrogenase, e.g., a d-amino-acid dehydrogenase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), GSSM and any combination thereof.

The term "saturation mutagenesis", "gene site saturation mutagenesis" or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

The invention provides nucleic acids (e.g., nucleic acids encoding polypeptides having a transferase activity, e.g., a transaminase activity, e.g., a d-amino-acid transferase activity, and/or an oxidoreductase activity, e.g., a dehydrogenase activity, e.g., a d-amino-acid dehydrogenase activity; including enzymes having at least one sequence modification of an exemplary nucleic acid sequence of the invention (as defined above), wherein the sequence modification comprises one or more nucleotide residue changes (or the equivalent thereof), including expression cassettes such as expression vectors, encoding the polypeptides of the invention.

The invention also includes methods for discovering new transferase, e.g., transaminase, e.g., d-amino-acid transferase, and/or oxidoreductase, e.g., dehydrogenase, e.g., d-amino-acid dehydrogenase sequences using the nucleic acids of the invention. The invention also includes methods for inhibiting the expression of transferase, e.g., transaminase, e.g., d-amino-acid transferase, and/or oxidoreductase, e.g., dehydrogenase, e.g., d-amino-acid dehydrogenase genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like.

In one aspect, the invention also provides transferase-, e.g., transaminase-, e.g., d-amino-acid transferase-, and/or oxidoreductase-, e.g., dehydrogenase-, e.g., d-amino-acid dehydrogenase-encoding nucleic acids with a common novelty in that they are derived from an environmental source, or a bacterial source, or an archaeal source.

In practicing the methods of the invention, homologous genes can be modified by manipulating a template nucleic acid, as described herein. The invention can be practiced in conjunction with any method or protocol or device known in the art, which are well described in the scientific and patent literature.

One aspect of the invention is an isolated, synthetic or recombinant nucleic acid comprising one of the sequences of The invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of a Sequence of the invention (or the sequences complementary thereto). The isolated, nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated, synthetic or recombinant nucleic acids of the invention may comprise RNA.

Accordingly, another aspect of the invention is an isolated, synthetic or recombinant nucleic acid which encodes one of the polypeptides of the invention, or fragments comprising at least 5, 10, 15, 20, 25, 30, 35, 40, 50, 75, 100, or 150 consecutive amino acids of one of the polypeptides of the invention. The coding sequences of these nucleic acids may be identical to one of the coding sequences of one of the nucleic acids of the invention, or a fragment thereof or may be different coding sequences which encode one of the polypeptides of the invention, sequences substantially identical thereto and fragments having at least 5, 10, 15, 20, 25, 30, 35, 40, 50, 75, 100, or 150 consecutive amino acids of one of the polypeptides of the invention, as a result of the redundancy or degeneracy of the genetic code. The genetic code is well known to those of skill in the art and can be obtained, for example, on page 214 of B. Lewin, *Genes VI*, Oxford University Press, 1997.

The isolated, synthetic or recombinant nucleic acid which encodes one of the polypeptides of the invention and sequences substantially identical thereto, may include, but is not limited to: only the coding sequence of a nucleic acid of the invention and sequences substantially identical thereto and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of the invention and sequences substantially identical thereto, may be mutagenized using conventional techniques, such as site directed mutagenesis, or other techniques familiar to those skilled in the art, to introduce silent changes into the polynucleotides of the invention and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention and sequences substantially identical thereto. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of The invention and sequences substantially identical thereto (or the sequences complementary thereto) under conditions of high, moderate, or low stringency as provided herein.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., transaminases and oxidoreductases of the invention) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACS), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197;

Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands that may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences.

In one aspect, the term "gene" means the segment of DNA involved in producing a polypeptide chain; it includes regions preceding and following the coding region (leader and trailer) as well as, where applicable, intervening sequences (introns) between individual coding segments (exons). In one aspect, "operably linked" as used herein refers to a functional relationship between two or more nucleic acid (e.g., DNA) segments. In one aspect, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. In one aspect, promoter transcriptional regulatory sequences are operably linked to a transcribed sequence and are physically contiguous to the transcribed sequence, i.e., they are cis-acting. In one aspect transcriptional regulatory sequences, such as enhancers, can be physically contiguous or located in close proximity to the coding sequences whose transcription they enhance.

In one aspect the term "expression cassette" refers to a nucleotide sequence which is capable of affecting expression of a structural gene (i.e., a protein coding sequence, such as a transferase, e.g., transaminase, e.g., d-amino-acid transferase, and/or oxidoreductase, e.g., dehydrogenase, e.g., d-amino-acid dehydrogenase of the invention) in a host compatible with such sequences. Expression cassettes include at least a promoter operably linked with the polypeptide coding sequence; and, in one aspect, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like. In one aspect, a "vector" comprises a nucleic acid that can infect, transfect, transiently or permanently transduce a cell. In alternative aspects a vector can be a naked nucleic acid, or a nucleic acid complexed with protein or lipid. The vector in one aspect comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

In one aspect, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

In alternative embodiments, "tissue-specific" promoters are transcriptional control elements that are only active in particular cells or tissues or organs, e.g., in plants or animals. Tissue-specific regulation may be achieved by certain intrinsic factors that ensure that genes encoding proteins specific to a given tissue are expressed. Such factors are known to exist in mammals and plants so as to allow for specific tissues to develop.

In alternative embodiments, the term "isolated" means that the material (e.g., a nucleic acid, a polypeptide, a cell) is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. In alternative embodiments, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. However, the term "purified" also includes nucleic acids that have been purified from the remainder of the genomic DNA or from other sequences in a library or other environment by at least one order of magnitude, typically two or three orders and more typically four or five orders of magnitude.

In alternative embodiments, the term "recombinant" means that the nucleic acid is adjacent to a "backbone" nucleic acid to which it is not adjacent in its natural environment. In alternative embodiments, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. In alternative embodiments, the enriched nucleic acids represent 15% or more of the number of nucleic acid inserts in the population of recombinant backbone molecules. In alternative embodiments, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

"Plasmids" are designated by a lower case "p" preceded and/or followed by capital letters and/or numbers. The starting plasmids herein are either commercially available, publicly available on an unrestricted basis, or can be constructed from available plasmids in accord with published procedures. In addition, equivalent plasmids to those described herein are known in the art and will be apparent to the ordinarily skilled artisan. "Plasmids" can be commercially available, publicly available on an unrestricted basis, or can be constructed from available plasmids in accord with published procedures. Equivalent plasmids to those described herein are known in the art and will be apparent to the ordinarily skilled artisan.

In alternative embodiments, "digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 □g of plasmid or DNA fragment is used with about 2 units of enzyme in about 20 □l of buffer solution. For the purpose of isolating DNA fragments for plasmid construction, typically 5 to 50 □g of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion, gel electrophoresis may be performed to isolate the desired fragment.

In alternative embodiments, "hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In alternative embodiments stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5×SSPE, 0.3% SDS and 200 ug/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I. A promoter sequence is "operably linked to" a coding sequence when RNA polymerase which initiates transcription at the promoter will transcribe the coding sequence into mRNA.

Promoters suitable for expressing a polypeptide in bacteria include the E. coli lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the E. coli lac or trp promoters, the lacI promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the ∀ factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express a transferase, e.g., transaminase, e.g., d-amino-acid transferase, and/or oxidoreductase, e.g., dehydrogenase, e.g., d-amino-acid dehydrogenase of the invention in a tissue-specific manner. The invention also provides plants or seeds that express a transferase, e.g., transaminase, e.g., d-amino-acid transferase, and/or oxidoreductase, e.g., dehydrogenase, e.g., d-amino-acid dehydrogenase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104: 1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro baciliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of transferase-, e.g., transaminase-, e.g., d-amino-acid transferase-, and/or oxidoreductase-, e.g., dehydrogenase-, e.g., d-amino-acid dehydrogenase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fbl2A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the transferase-, e.g., transaminase-, e.g., d-amino-acid transferase-, and/or oxidoreductase-, e.g., dehydrogenase-, e.g., d-amino-acid dehydrogenase-producing nucleic acids of the invention will allow the grower to select plants with the optimal transferase, e.g., transaminase, e.g., d-amino-acid transferase, and/or oxidoreductase, e.g., dehydrogenase, e.g., d-amino-acid dehydrogenase expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the *Agrobacterial* T-DNA.

The term "plant" (e.g., as in a transgenic plant or plant seed of this invention, or plant promoter used in a vector of the invention) includes whole plants, plant parts (e.g., leaves, stems, flowers, roots, etc.), plant protoplasts, seeds and plant cells and progeny of same; the classes of plants that can be used to practice this invention (including compositions and methods) can be as broad as the class of higher plants, including plants amenable to transformation techniques, including angiosperms (monocotyledonous and dicotyledonous plants), as well as gymnosperms; also including plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes, such a vectors) of the invention. Transgenic plants of the invention are also discussed, below.

Expression Vectors and Cloning Vehicles

The invention provides expression vectors and cloning vehicles comprising nucleic acids of the invention, e.g., sequences encoding the transferases, e.g., transaminases, e.g., d-amino-acid transferases, and/or oxidoreductases, e.g., dehydrogenases, e.g., d-amino-acid dehydrogenases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP 1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin by 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal minichromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234:243-252), bean golden mosaic virus (see, e.g., Morinaga (1993) Microbiol Immunol. 37:471-476), cauliflower mosaic virus (see, e.g., Cecchini (1997) Mol. Plant Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda $P_R$, $P_L$, and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin by 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention and sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. The nucleic acid can encode a fusion polypeptide in which one of the polypeptides of the invention and sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., Molecular Cloning: A Laboratory Manual 2nd Ed., Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., *Molecular Cloning: A Laboratory Manual, 2nd Ed.*, Cold Spring Harbor, N.Y., (1989).

Host Cells and Transformed Cells

The invention also provides transformed cells comprising a nucleic acid sequence of the invention, e.g., a sequence encoding a transferase, e.g., a transaminase, e.g., a d-aminoacid transferase, and/or an oxidoreductase, e.g., a dehydrogenase, e.g., a d-amino-acid dehydrogenase of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include any species within the genera *Escherichia, Bacillus, Streptomyces, Salmonella, Pseudomonas* and *Staphylococcus*, including, e.g., *Escherichia coli, Lactococcus lactis, Bacillus subtilis, Bacillus cereus, Salmonella typhimurium, Pseudomonas fluorescens*. Exemplary fungal cells include any species of *Aspergillus*. Exemplary yeast cells include any species of *Pichia, Saccharomyces, Schizosaccharomyces,* or *Schwanniomyces,* including *Pichia pastoris, Saccharomyces cerevisiae,* or *Schizosaccharomyces pombe*. Exemplary insect cells include any species of *Spodoptera* or *Drosophila,* including *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include CaPO$_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant transferase, e.g., transaminase, e.g., d-amino-acid transferase, and/or oxidoreductase, e.g., dehydrogenase, e.g., d-amino-acid dehydrogenase in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of the invention over a region of at least about 100 residues, wherein the sequence identities are determined by analysis with a sequence comparison algorithm or by visual inspection, or, a nucleic acid that hybridizes under stringent conditions to a nucleic acid sequence of the invention, or a subsequence thereof. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

Additional details regarding this approach are in the public literature and/or are known to the skilled artisan. In a particular non-limiting exemplification, such publicly available literature includes: Journal of Bacteriology. 1998 August. 180 (16):4319-4323; Applied Microbiology and Biotechnology. 2003 June. 61(5-6):463-471; Gene. 1996 October. 177(1): 217-222; J Bacteriol. 1994 June; 176(12): 3552-3558; JBC. 1997 September. 272(37):23303-23311, although these references do not teach the inventive enzymes of the instant application.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Bacillus cereus, Salmonella typhimurium* and various species within the genera *Pseudomonas, Streptomyces* and *Staphylococcus*, fungal cells, such as *Aspergillus*, yeast such as any species of *Pichia, Saccharomyces, Schizosaccharomyces, Schwanniomyces*, including *Pichia pastoris, Saccharomyces cerevisiae*, or *Schizosaccharomyces pombe*, insect cells such as *Drosophila* S2 and *Spodoptera* Sf9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of amino acid sequences of the invention, or fragments comprising at least 5, 10, 15, 20, 25, 30, 35, 40, 50, 75, 100, or 150 consecutive amino acids thereof can be synthetically produced by conventional peptide synthesizers. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of amino acid sequences of the invention, or fragments comprising at least 5, 10, 15, 20, 25, 30, 35, 40, 50, 75, 100, or 150 consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the transferases, e.g., transaminases, e.g., d-amino-acid transferases, and/or oxidoreductases, e.g., dehydrogenases, e.g., d-amino-acid dehydrogenases of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, or 25 residues of a nucleic acid of the invention, and about the first (the 5') 15, 16, 17, 18, 19, 20, 21, 22, 23, 24, or 25 residues of the complementary strand.

The invention provides an amplification primer sequence pair for amplifying a nucleic acid encoding a polypeptide having a transferase, e.g., transaminase, e.g., d-amino-acid transferase, and/or oxidoreductase, e.g., dehydrogenase, e.g., d-amino-acid dehydrogenase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, or 25 consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 residues of a nucleic acid of the invention, and a second member having a sequence as set forth by about the first (the 5') 12, 13, 14, 15, 16, 17, 18, 19, 20, 21, 22, 23, 24, or 25 residues of the complementary strand of the first member. The invention provides transferases, e.g., transaminases, e.g., d-amino-acid transferases, and/or oxidoreductases, e.g., dehydrogenases, e.g., d-amino-acid dehydrogenases generated by amplification, e.g., polymerase chain reaction (PCR), using an amplification primer pair of the invention. The invention provides methods of making a transferase, e.g., transaminase, e.g., d-amino-acid transferase, and/or oxidoreductase, e.g., dehydrogenase, e.g., d-amino-acid dehydrogenase by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides isolated, recombinant and/or synthetic nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (as defined above) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

In alternative embodiments, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

In alternative embodiments, the phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. Typically, the substantial identity exists over a region of at least about 100 residues and most commonly the sequences are substantially identical over at least about 150-200 residues. In some aspects, the sequences are substantially identical over the entire length of the coding regions.

In alternative embodiments, a "substantially identical" amino acid sequence is a sequence that differs from a reference sequence by one or more conservative or non-conservative amino acid substitutions, deletions, or insertions, particularly when such a substitution occurs at a site that is not the active site of the molecule and provided that the polypeptide essentially retains its functional properties. In alternative embodiments a conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a transferase, e.g., transaminase, e.g., d-amino-acid transferase, and/or oxidoreductase, e.g., dehydrogenase, e.g., d-amino-acid dehydrogenase polypeptide, resulting in modification of the structure of the polypeptide, without significantly altering its biological activity. For example, amino- or carboxyl-terminal amino acids that are not required for transferase, e.g., transaminase, e.g., d-amino-acid transferase, and/or oxidoreductase, e.g., dehydrogenase, e.g., d-amino-acid dehydrogenase biological activity can be removed. Modified polypeptide sequences of the invention can be assayed for transferase, e.g., transaminase, e.g., d-amino-acid transferase, and/or oxidoreductase, e.g., dehydrogenase, e.g., d-amino-acid dehydrogenase biological activity by any number of methods, including contacting the modified polypeptide sequence with a transferase, e.g., transaminase, e.g., d-amino-acid transferase, and/or oxidoreductase, e.g., dehydrogenase, e.g., d-amino-acid dehydrogenase substrate and determining whether the modified polypeptide decreases the amount of specific substrate in the assay or increases the bioproducts of the enzymatic reaction of a functional transferase, e.g., transaminase, e.g., d-amino-acid transferase, and/or oxidoreductase, e.g., dehydrogenase, e.g., d-amino-acid dehydrogenase polypeptide with the substrate.

Nucleic acid sequences of the invention can comprise at least 10, 15, 20, 25, 30, 35, 40, 50, 75, 100, 150, 200, 300, 400, or 500 consecutive nucleotides of an exemplary sequence of the invention and sequences substantially identical thereto. Nucleic acid sequences of the invention can comprise homologous sequences and fragments of nucleic acid sequences and sequences substantially identical thereto, refer to a sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences. Homology may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention and sequences substantially identical thereto, can be represented in the traditional single character format (See the inside back cover of Stryer, Lubert. Biochemistry, 3rd Ed., W. H Freeman & Co., New York.) or in any other format which records the identity of the nucleotides in a sequence.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

In alternative embodiments a "comparison window" includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project. At least twenty-one other genomes have already been sequenced, including, for example, M. genitalium (Fraser et al., 1995), M. jannaschii (Bult et al., 1996), H. influenzae (Fleischmann et al., 1995), E. coli (Blattner et al., 1997) and yeast (S. cerevisiae) (Mewes et al., 1997) and D. melanogaster (Adams et al., 2000). Significant progress has also been made in sequencing the genomes of model organism, such as mouse, C. elegans and Arabadopsis sp. Several databases containing genomic information annotated with some functional information are maintained by different organization and are accessible via the internet One example of a useful algorithm is BLAST and BLAST 2.0 algorithms, which are described in Altschul et al., Nuc. Acids Res. 25:3389-3402, 1977 and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=−4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01 and most preferably less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary sequence of the invention, e.g., a polypeptide sequences of the invention.

Homology may be determined using any of the computer programs and parameters described herein, including FASTA version 3.0t78 with the default parameters or with any modified parameters. The homologous sequences may be obtained using any of the procedures described herein or may result from the correction of a sequencing error. The polypeptide fragments comprise at least about 10, 15, 20, 25, 30, 35, 40, 45, 50, 75, 100, 150, 200, 250, 300, 350, 400, 450, 500 or more consecutive amino acids of the polypeptides of the invention and sequences substantially identical thereto. It will be appreciated that the polypeptide codes of amino acid sequences of the invention and sequences substantially identical thereto, can be represented in the traditional single character format or three letter format (See Stryer, Lubert. *Biochemistry*, 3rd Ed., supra) or in any other format which relates the identity of the polypeptides in a sequence.

A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention and sequences substantially identical thereto, one or more of the polypeptide sequences of the invention and sequences substantially identical thereto. Another aspect of the invention is a computer readable medium having recorded thereon at least 2, 5, 10, 15, or 20 or more nucleic acid sequences of the invention and sequences substantially identical thereto.

Another aspect of the invention is a computer readable medium having recorded thereon one or more of the nucleic acid sequences of the invention and sequences substantially identical thereto. Another aspect of the invention is a computer readable medium having recorded thereon one or more of the polypeptide sequences of the invention and sequences substantially identical thereto. Another aspect of the invention is a computer readable medium having recorded thereon at least 2, 5, 10, 15, or 20 or more of the sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention and sequences substantially identical thereto, or a polypeptide sequence as set forth in the amino acid sequences of the invention. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (preferably implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence of the invention and sequences substantially identical thereto, or a polypeptide sequence of the invention and sequences substantially identical thereto, (such as search tools, compare tools and modeling tools etc.) may reside in main memory 115 during execution.

In some aspects, the computer system 100 may further comprise a sequence comparison algorithm for comparing a nucleic acid sequence of the invention and sequences substantially identical thereto, or a polypeptide sequence of the invention and sequences substantially identical thereto, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention and sequences substantially identical thereto, or a polypeptide sequence of the invention and sequences substantially identical thereto, stored on a computer readable medium to reference sequences stored on a computer readable medium to identify homologies or structural motifs.

Figure 2:
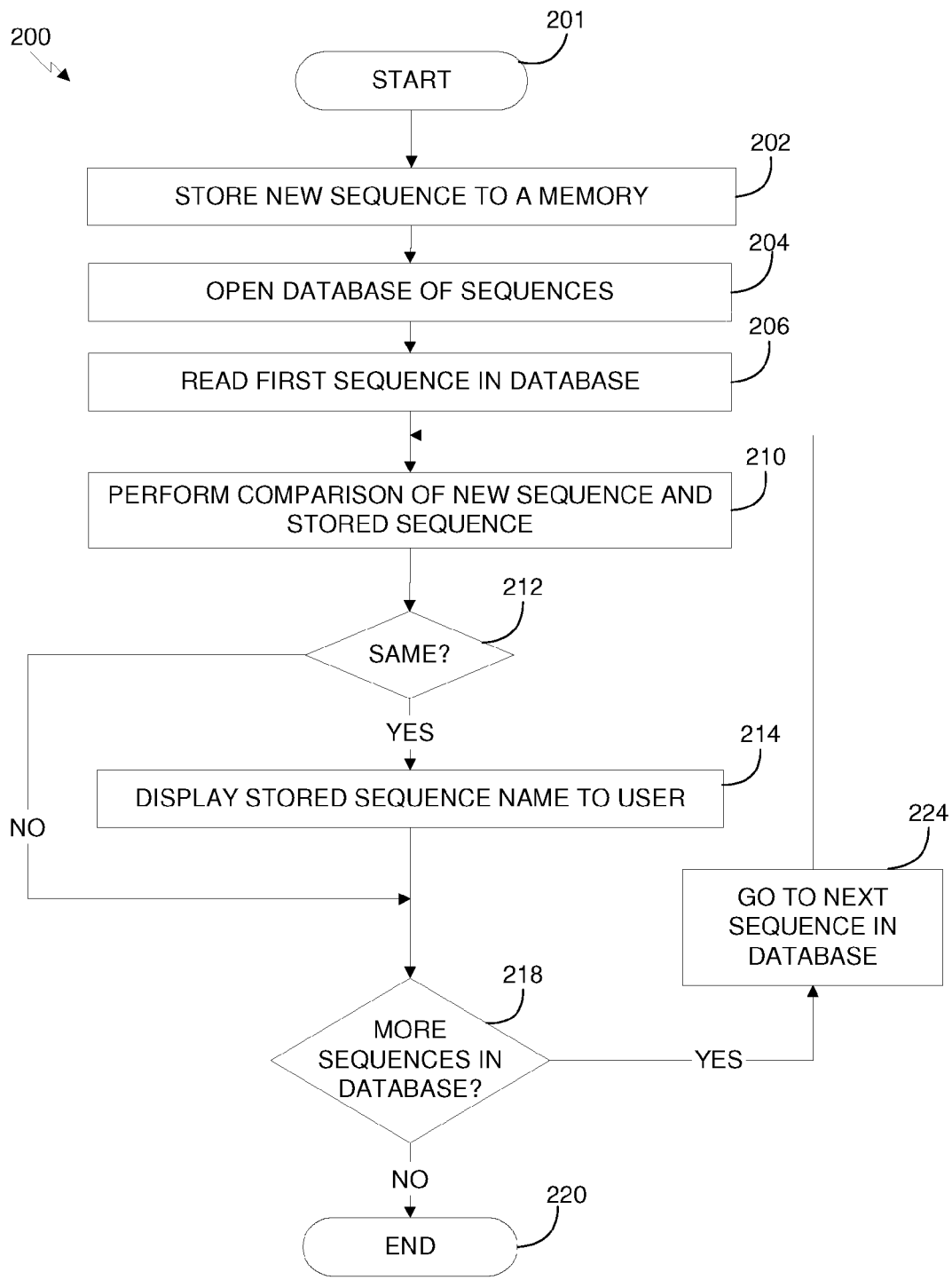
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user.

This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention and sequences substantially identical thereto, or a polypeptide sequence of the invention and sequences substantially identical thereto, a data storage device having retrievably stored thereon reference nucleotide sequences or polypeptide sequences to be compared to a nucleic acid sequence of the invention and sequences substantially identical thereto, or a polypeptide sequence of the invention and sequences substantially identical thereto and a sequence comparer for conducting the comparison. The sequence comparer may indicate a homology level between the sequences compared or identify structural motifs in the above described nucleic acid code of nucleic acid sequences of the invention and sequences substantially identical thereto, or a polypeptide sequence of the invention and sequences substantially identical thereto, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention and sequences substantially identical thereto, or the polypeptide sequences of the invention and sequences substantially identical thereto.

Another aspect of the invention is a method for determining the level of homology between a nucleic acid sequence of the invention and sequences substantially identical thereto, or a polypeptide sequence of the invention and sequences substantially identical thereto and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, 30 or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
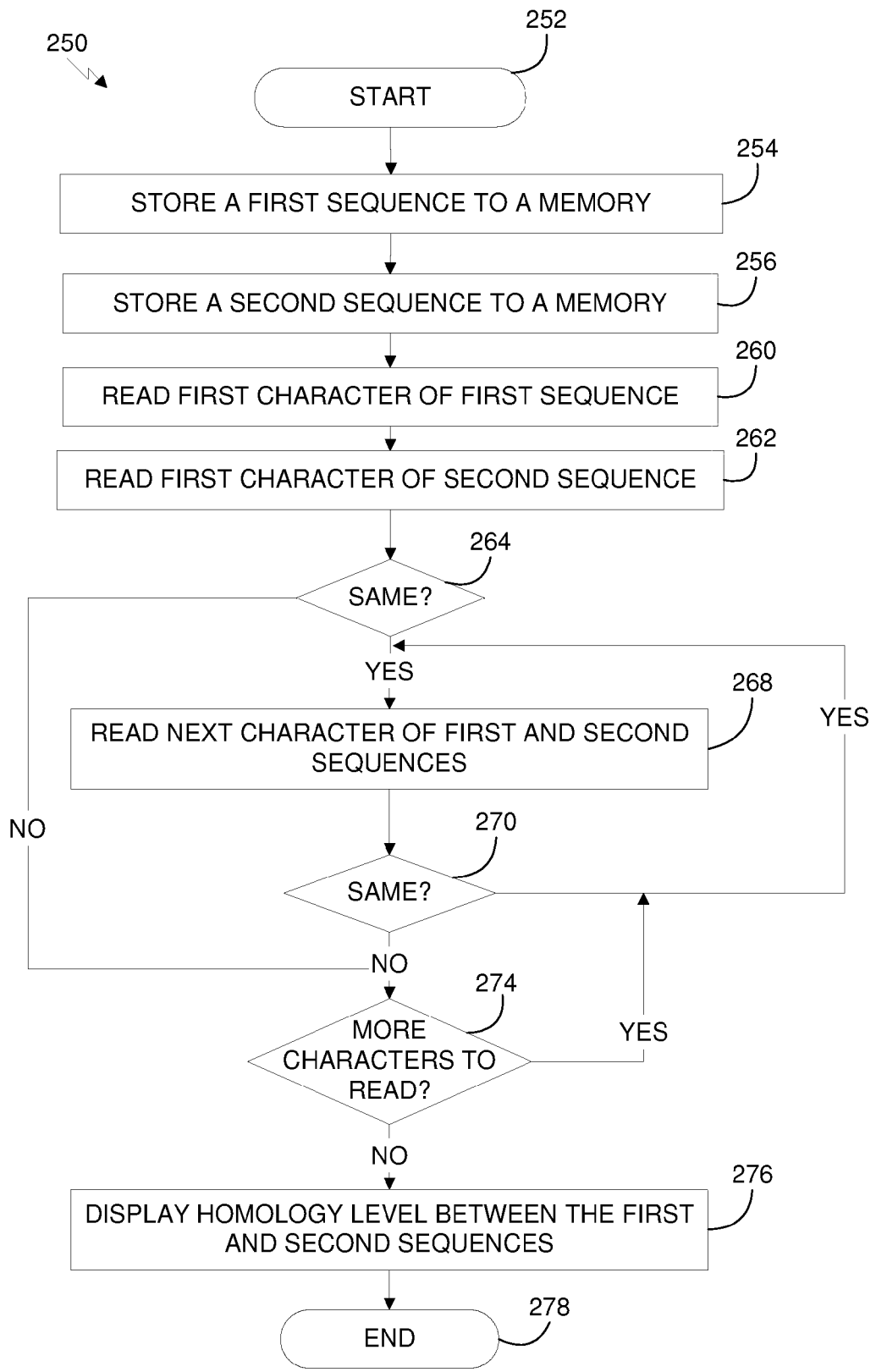
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is preferably in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of a nucleic acid sequence of the invention and sequences substantially identical thereto, differs from a reference nucleic acid sequence at one or more positions. In one aspect such a program records the length and identity of inserted, deleted or substituted nucleotides with respect to the sequence of either the reference polynucleotide or a nucleic acid sequence of the invention and sequences substantially identical thereto. In one aspect, the computer program may be a program which determines whether a nucleic acid sequence of the invention and sequences substantially identical thereto, contains a single nucleotide polymorphism (SNP) with respect to a reference nucleotide sequence.

Another aspect of the invention is a method for determining whether a nucleic acid sequence of the invention and sequences substantially identical thereto, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and sequences substantially identical thereto and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention and sequences substantially identical thereto.

An "identifier" refers to one or more programs which identifies certain features within a nucleic acid sequence of the invention and sequences substantially identical thereto, or a polypeptide sequence of the invention and sequences substantially identical thereto. In one aspect, the identifier may comprise a program which identifies an open reading frame in a nucleic acid sequence of the invention and sequences substantially identical thereto.

Figure 4:
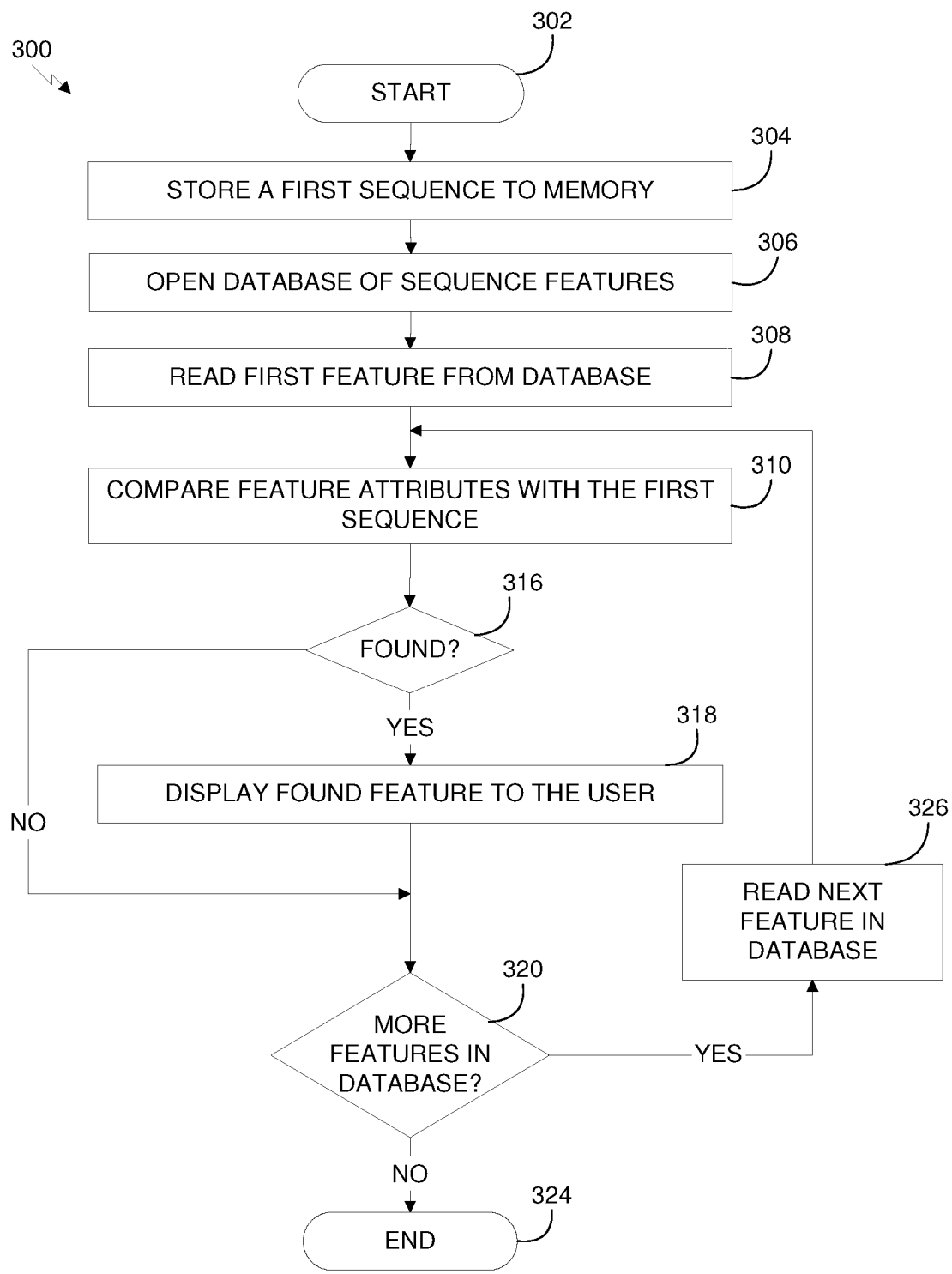
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention and sequences substantially identical thereto, or a polypeptide sequence of the invention and sequences substantially identical thereto, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences of the invention and sequences substantially identical thereto, or the polypeptide sequences of the invention and sequences substantially identical thereto, through the use of the computer program and identifying features within the nucleic acid codes or polypeptide codes with the computer program.

A nucleic acid sequence of the invention and sequences substantially identical thereto, or a polypeptide sequence of the invention and sequences substantially identical thereto, may be stored and manipulated in a variety of data processor programs in a variety of formats. For example, a nucleic acid sequence of the invention and sequences substantially identical thereto, or a polypeptide sequence of the invention and sequences substantially identical thereto, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence of the invention and sequences substantially identical thereto, or a polypeptide sequence of the invention and sequences substantially identical thereto. The following list is intended not to limit the invention but to provide guidance to programs and databases which are useful with the nucleic acid sequences of the invention and sequences substantially identical thereto, or the polypeptide sequences of the invention and sequences substantially identical thereto.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated, synthetic or recombinant nucleic acids that hybridize under stringent conditions to an exemplary sequence of the invention. The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5× SSPE, 0.3% SDS, and a repetitive sequence blocking nucleic acid, such as cot-1 or salmon sperm DNA (e.g., 200 ug/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10×Denhardt's and 0.5 mg/ml polyriboadenylic acid. Approximately $2×10^7$ cpm (specific activity $4-9×10^8$ cpm/ug) of $^{32}P$ end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM $Na_2EDTA$) containing 0.5% SDS, followed by a 30 minute wash in fresh 1×SET at $T_m$-10° C. for the oligonucleotide probe. The membrane is then exposed to auto-radiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% homology to a nucleic acid sequence selected from the group consisting of one of the sequences of The invention and sequences substantially identical thereto, or fragments comprising at least about 10, 15, 20, 25, 30, 35, 40, 50, 75, 100, 150, 200, 300, 400, or 500 consecutive bases thereof and the sequences complementary thereto. Homology may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of the invention or the sequences complementary thereto.

Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% homology to a polypeptide having the sequence of one of amino acid sequences of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying nucleic acids encoding a polypeptide with a transferase, e.g., transaminase, e.g., d-amino-acid transferase, and/or oxidoreductase, e.g., dehydrogenase, e.g., d-amino-acid dehydrogenase activity or fragments thereof or for identifying transferase, e.g., transaminase, e.g., d-amino-acid transferase, and/or oxidoreductase, e.g., dehydrogenase, e.g., d-amino-acid dehydrogenase genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated, synthetic or recombinant nucleic acids of the invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of The invention and sequences substantially identical thereto, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. *Current Protocols in Molecular Biology*, John Wiley 503 Sons, Inc. (1997) and Sambrook et al., *Molecular Cloning: A Laboratory Manual 2nd Ed.*, Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3 SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification—an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of The invention and sequences substantially identical thereto, may also be used in chromosome walking procedures to identify clones containing genomic sequences located adjacent to the sequences of The invention and sequences substantially identical thereto. Such methods allow the isolation of genes which encode additional proteins from the host organism.

The isolated, synthetic or recombinant nucleic acids of the invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of the invention and sequences substantially identical thereto, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log [\text{Na}+])+0.41(\text{fraction } G+C)-(600/N)$ where N is the length of the probe.

If the hybridization is carried out in a solution containing formamide, the melting temperature may be calculated using the equation: $T_m=81.5+16.6(\log [\text{Na}+])+0.41(\text{fraction } G+C)-(0.63\% \text{ formamide})-(600/N)$ where N is the length of the probe.

Prehybridization may be carried out in 6×SSC, 5×Denhardt's reagent, 0.5% SDS, 100 □g/ml denatured fragmented salmon sperm DNA or 6×SSC, 5×Denhardt's reagent, 0.5% SDS, 100 □g/ml denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10□C below the $T_m$. Typically, for hybridizations in 6×SSC, the hybridization is conducted at approximately 68° C. Usually, for hybridizations in 50% formamide containing solutions, the hybridization is conducted at approximately 42° C.

Inhibiting Expression of Transaminases and/or Oxidoreductases

The invention provides nucleic acids complementary to (e.g., antisense sequences to) the nucleic acids of the invention, e.g., transferase-, e.g., transaminase-, e.g., d-amino-acid transferase-, and/or oxidoreductase-, e.g., dehydrogenase-, e.g., d-amino-acid dehydrogenase-encoding nucleic acids. In alternative embodiments antisense sequences of the invention are capable of inhibiting the transport, splicing or transcription of transferase-, e.g., transaminase-, e.g., d-amino-acid transferase-, and/or oxidoreductase-, e.g., dehydrogenase-, e.g., d-amino-acid dehydrogenase-encoding genes. The inhibition can be effected through the targeting of genomic DNA or messenger RNA. The transcription or function of targeted nucleic acid can be inhibited, for example, by hybridization and/or cleavage. In alternative embodiments inhibitors provided by the present invention includes oligonucleotides which are able to either bind a transferase, e.g., transaminase, e.g., d-amino-acid transferase, and/or oxidoreductase, e.g., dehydrogenase, e.g., d-amino-acid dehydrogenase gene or message, in either case preventing or inhibiting the production or function of a transferase, e.g., transaminase, e.g., d-amino-acid transferase, and/or oxidoreductase, e.g., dehydrogenase, e.g., d-amino-acid dehydrogenase. The association can be through sequence specific hybridization. Another useful class of inhibitors includes oligonucleotides which cause inactivation or cleavage of a transferase, e.g., transaminase, e.g., d-amino-acid transferase, and/or oxidoreductase, e.g., dehydrogenase, e.g., d-amino-acid dehydrogenase message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of transferase, e.g., transaminase, e.g., d-amino-acid transferase, and/or oxidoreductase, e.g., dehydrogenase, e.g., d-amino-acid dehydrogenase expression on a nucleic acid and/or protein level, e.g., antisense, iRNA and ribozymes comprising transferase, e.g., transaminase, e.g., d-amino-acid transferase, and/or oxidoreductase, e.g., dehydrogenase, e.g., d-amino-acid dehydrogenase sequences of the invention and the anti-transferase, e.g., anti-transaminase, e.g., anti-d-amino-acid transferase, and/or anti-oxidoreductase, e.g., anti-dehydrogenase, e.g., anti-d-amino-acid dehydrogenase antibodies of the invention.

The compositions of the invention for the inhibition of transferase, e.g., transaminase, e.g., d-amino-acid transferase, and/or oxidoreductase, e.g., dehydrogenase, e.g., d-amino-acid dehydrogenase expression (e.g., antisense, iRNA, microRNA, ribozymes, antibodies) can be used as pharmaceutical (drug) compositions.

Antisense Oligonucleotides

The invention provides antisense oligonucleotides capable of binding a transferase, e.g., transaminase, e.g., d-amino-acid transferase, and/or oxidoreductase, e.g., dehydrogenase, e.g., d-amino-acid dehydrogenase message which can inhibit, for example, transferase and/or dehydrogenase activity by targeting mRNA. Strategies for designing antisense oligonucleotides are well described in the scientific and patent literature, and the skilled artisan can design such transferase, e.g., transaminase, e.g., d-amino-acid transferase, and/or oxidoreductase, e.g., dehydrogenase, e.g., d-amino-acid dehydrogenase oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense transferase, e.g., transaminase, e.g., d-amino-acid transferase, and/or oxidoreductase, e.g., dehydrogenase, e.g., d-amino-acid dehydrogenase sequences of the invention (see, e.g., Gold (1995) J. of Biol. Chem. 270: 13581-13584).

Inhibitory Ribozymes

The invention provides ribozymes capable of binding a transferase, e.g., transaminase, e.g., d-amino-acid transferase, and/or oxidoreductase, e.g., dehydrogenase, e.g., d-amino-acid dehydrogenase message. These ribozymes can inhibit transferase, e.g., transaminase, e.g., d-amino-acid transferase, and/or oxidoreductase, e.g., dehydrogenase, e.g., d-amino-acid dehydrogenase activity by, e.g., targeting mRNA. Strategies for designing ribozymes and selecting the transferase-, e.g., transaminase-, e.g., d-amino-acid transferase-, and/or oxidoreductase-, e.g., dehydrogenase-, e.g., d-amino-acid dehydrogenase-specific antisense sequence for targeting are well described in the scientific and patent literature, and the skilled artisan can design such ribozymes using the novel reagents (e.g., nucleic acids) of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a transferase, e.g., transaminase, e.g., d-amino-acid transferase, and/or oxidoreductase, e.g., dehydrogenase, e.g., d-amino-acid dehydrogenase enzyme sequence of the invention. The RNAi molecule can comprise a double-stranded RNA (dsRNA) molecule, e.g., an siRNA, a microRNA (miRNA) and/or short hairpin RNA (shRNA) molecules. The RNAi molecule, e.g., siRNA (small inhibitory RNA) can inhibit expression of a transferase, e.g., transaminase, e.g., d-amino-acid transferase, and/or oxidoreductase, e.g., dehydrogenase, e.g., d-amino-acid dehydrogenase enzyme gene, and/or miRNA (micro RNA) to inhibit translation of a transferase, e.g., transaminase, e.g., d-amino-acid transferase, and/or oxidoreductase, e.g., dehydrogenase, e.g., d-amino-acid dehydrogenase message. In one aspect, the RNAi molecule, e.g., siRNA and/or miRNA, is about 11, 12, 13, 14, 15, 16, 17, 18, 19, 20, 21, 22, 23, 24, 25, 26, 27, 28, 29 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's molecules, e.g., siRNA and/or miRNA, of the invention. The process may be practiced in vitro, ex vivo or in vivo. In one aspect, the RNAi molecules of the invention can be used to generate a loss-of-function mutation in a cell, an organ or an animal.

In one aspect, intracellular introduction of the RNAi is by internalization of a target cell specific ligand bonded to an RNA binding protein comprising an RNAi (e.g., microRNA) is adsorbed. The ligand is specific to a unique target cell surface antigen. The ligand can be spontaneously internalized after binding to the cell surface antigen. If the unique cell surface antigen is not naturally internalized after binding to its ligand, internalization can be promoted by the incorporation of an arginine-rich peptide, or other membrane permeable peptide, into the structure of the ligand or RNA binding protein or attachment of such a peptide to the ligand or RNA binding protein. See, e.g., U.S. Patent App. Pub. Nos. 20060030003; 20060025361; 20060019286; 20060019258. In one aspect, the invention provides lipid-based formulations for delivering, e.g., introducing nucleic acids of the invention as nucleic acid-lipid particles comprising an RNAi molecule to a cell, see e.g., U.S. Patent App. Pub. No. 20060008910.

Methods for making and using RNAi molecules, e.g., siRNA and/or miRNA, for selectively degrade RNA are well known in the art, see, e.g., U.S. Pat. No. 6,506,559; U.S. Pat. No. 6,511,824; U.S. Pat. No. 6,515,109; U.S. Pat. No. 6,489,127.

Modification of Nucleic Acids

The invention provides methods of generating variants of the nucleic acids of the invention, e.g., those encoding a transferase, e.g., transaminase, e.g., d-amino-acid transferase, and/or oxidoreductase, e.g., dehydrogenase, e.g., d-amino-acid dehydrogenase. These methods can be repeated or used in various combinations to generate transferases, e.g., transaminases, e.g., d-amino-acid transferases, and/or oxidoreductases, e.g., dehydrogenases, e.g., d-amino-acid dehydrogenases having an altered or different activity or an altered or different stability from that of a transferase, e.g., transaminase, e.g., d-amino-acid transferase, and/or oxidoreductase, e.g., dehydrogenase, e.g., d-amino-acid dehydrogenase encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

In alternative embodiments, a nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photoactivated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), gene site saturation mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255:373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM), synthetic ligation reassembly (SLR), or a combination thereof are used to modify the nucleic acids of the invention to generate transferases, e.g., transaminases, e.g., d-amino-acid transferases, and/or oxidoreductases, e.g., dehydrogenases, e.g., d-amino-acid dehydrogenases with new or altered properties (e.g., activity under highly acidic or alkaline conditions, high or low temperatures, and the like). Polypeptides encoded by the modified nucleic acids can be screened for an activity. Any testing modality or protocol can be used, e.g., using a capillary array platform. See, e.g., U.S. Pat. Nos. 6,361,974; 6,280,926; 5,939,250.

Gene Site Saturation Mutagenesis, or, GSSM

The invention also provides methods for making enzyme using Gene Site Saturation mutagenesis, or, GSSM, as described herein, and also in U.S. Pat. Nos. 6,171,820 and 6,579,258. In one aspect, codon primers containing a degenerate N,N,G/T sequence are used to introduce point mutations into a polynucleotide, e.g., a transferase, e.g., transaminase, e.g., d-amino-acid transferase, and/or oxidoreductase, e.g., dehydrogenase, e.g., d-amino-acid dehydrogenase or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, in one aspect, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position×100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can in one aspect be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., transferases, e.g., transaminases, e.g., d-amino-acid transferases, and/or oxidoreductases, e.g., dehydrogenases, e.g., d-amino-acid dehydrogenases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., *E. coli* host, using, e.g., an expression vector) and subjected to expression screening. When an individual progeny polypeptide is identified by screening to display a favorable change in property (when compared to the parental polypeptide, such as increased transferase activity, e.g., transaminase activity, e.g., d-amino-acid transferase activity, and/or oxidoreductase activity, e.g., dehydrogenase activity, e.g., d-amino-acid dehydrogenase activity or a ω-transaminase activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process(es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (gene site saturation mutagenesis (GSSM)). The oligos used are comprised contiguously of a first homologous sequence, a degenerate N,N,N sequence and preferably but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate (N,N,N)$_n$ sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can in one aspect be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable *E. coli* host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is preferably every integer from 15 to 100,000. Thus, instead of mutagenizing every position along a molecule, one can subject every or a discrete number of bases (preferably a subset totaling from 15 to 100,000) to mutagenesis. Preferably, a separate nucleotide is used for mutagenizing each position or group of positions along a polynucleotide sequence. A group of 3 positions to be mutagenized may be a codon. The mutations are preferably introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is preferably about 1-500 bases in length) in defined polynucleotide sequence to be mutagenized (wherein the sequence to be mutagenized is preferably from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., transferases, e.g., transaminases, e.g., d-amino-acid transferases, and/or oxidoreductases, e.g., dehydrogenases, e.g., d-amino-acid dehydrogenases, or antibodies of the invention, with new or altered properties.

SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776. In one aspect, SLR comprises: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

Synthetic Gene Reassembly

In one aspect, the present invention provides a non-stochastic method termed synthetic gene reassembly (e.g., GeneReassembly, see, e.g., U.S. Pat. No. 6,537,776), which differs from stochastic shuffling in that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

In one aspect, synthetic gene reassembly comprises a method of: 1) preparing a progeny generation of molecule(s) (including a molecule comprising a polynucleotide sequence, e.g., a molecule comprising a polypeptide coding sequence), that is mutagenized to achieve at least one point mutation, addition, deletion, &/or chimerization, from one or more ancestral or parental generation template(s); 2) screening the progeny generation molecule(s), e.g., using a high throughput method, for at least one property of interest (such as an improvement in an enzyme activity); 3) in one aspect obtaining &/or cataloguing structural &/or and functional information regarding the parental &/or progeny generation molecules; and 4) in one aspect repeating any of steps 1) to 3). In one aspect, there is generated (e.g., from a parent polynucleotide template), in what is termed "codon site-saturation mutagenesis," a progeny generation of polynucleotides, each having at least one set of up to three contiguous point mutations (i.e. different bases comprising a new codon), such that every codon (or every family of degenerate codons encoding the same amino acid) is represented at each codon position. Corresponding to, and encoded by, this progeny generation of polynucleotides, there is also generated a set of progeny polypeptides, each having at least one single amino acid point mutation. In a one aspect, there is generated, in what is termed "amino acid site-saturation mutagenesis", one such mutant polypeptide for each of the 19 naturally encoded polypeptide-forming alpha-amino acid substitutions at each and every amino acid position along the polypeptide. This yields, for each and every amino acid position along the parental polypeptide, a total of 20 distinct progeny polypeptides including the original amino acid, or potentially more than 21 distinct progeny polypeptides if additional amino acids are used either instead of or in addition to the 20 naturally encoded amino acids Thus, in another aspect, this approach is also serviceable for generating mutants containing, in addition to &/or in combination with the 20 naturally encoded polypeptide-forming alpha-amino acids, other rare &/or not naturally-encoded amino acids and amino acid derivatives. In yet another aspect, this approach is also serviceable for generating mutants by the use of, in addition to &/or in combination with natural or unaltered codon recognition systems of suitable hosts, altered, mutagenized, &/or designer codon recognition systems (such as in a host cell with one or more altered tRNA molecules.

In yet another aspect, this invention relates to recombination and more specifically to a method for preparing polynucleotides encoding a polypeptide by a method of in vivo re-assortment of polynucleotide sequences containing regions of partial homology, assembling the polynucleotides to form at least one polynucleotide and screening the polynucleotides for the production of polypeptide(s) having a useful property.

In yet another aspect, this invention is serviceable for analyzing and cataloguing, with respect to any molecular property (e.g. an enzymatic activity) or combination of properties allowed by current technology, the effects of any mutational change achieved (including particularly saturation mutagenesis). Thus, a comprehensive method is provided for determining the effect of changing each amino acid in a parental polypeptide into each of at least 19 possible substitutions. This allows each amino acid in a parental polypeptide to be characterized and catalogued according to its spectrum of potential effects on a measurable property of the polypeptide.

In one aspect, an intron may be introduced into a chimeric progeny molecule by way of a nucleic acid building block. Introns often have consensus sequences at both termini in order to render them operational. In addition to enabling gene splicing, introns may serve an additional purpose by providing sites of homology to other nucleic acids to enable homologous recombination. For this purpose, and potentially others, it may be sometimes desirable to generate a large nucleic acid building block for introducing an intron. If the size is overly large easily generating by direct chemical synthesis of two single stranded oligos, such a specialized nucleic acid building block may also be generated by direct chemical synthesis of more than two single stranded oligos or by using a polymerase-based amplification reaction The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

Coupling can occur in a manner that does not make use of every nucleotide in a participating overhang. The coupling is particularly lively to survive (e.g. in a transformed host) if the coupling reinforced by treatment with a ligase enzyme to form what may be referred to as a "gap ligation" or a "gapped ligation". This type of coupling can contribute to generation of unwanted background product(s), but it can also be used advantageously increase the diversity of the progeny library generated by the designed ligation reassembly. Certain overhangs are able to undergo self-coupling to form a palindromic coupling. A coupling is strengthened substantially if it is reinforced by treatment with a ligase enzyme. Lack of 5' phosphates on these overhangs can be used advantageously to prevent this type of palindromic self-ligation. Accordingly, this invention provides that nucleic acid building blocks can be chemically made (or ordered) that lack a 5' phosphate group. Alternatively, they can be removed, e.g. by treatment with a phosphatase enzyme, such as a calf intestinal alkaline phosphatase (CIAP), in order to prevent palindromic self-ligations in ligation reassembly processes.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The transferases, e.g., transaminases, e.g., d-amino-acid transferases, and/or oxidoreductases, e.g., dehydrogenases, e.g., d-amino-acid dehydrogenases of the present invention can be mutagenized in accordance with the methods described herein.

Thus according to one aspect of the invention, the sequences of a plurality of progenitor nucleic acid templates (e.g., polynucleotides of The invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and preferably at almost all of the progenitor templates. Even more preferably still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated preferably comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be in one aspect removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). Preferably, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In a one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. The codon degeneracy can be introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., transferases, e.g., transaminases, e.g., d-amino-acid transferases, and/or oxidoreductases, e.g., dehydrogenases, e.g., d-amino-acid dehydrogenases, or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332, 835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new transferase, e.g., transaminase, e.g., d-amino-acid transferase, and/or oxidoreductase, e.g., dehydrogenase, e.g., d-amino-acid dehydrogenase phenotype is identified, re-isolated, again modified, re-tested for activity. This process can be iteratively repeated until a desired phenotype is engineered. For example, an entire biochemical anabolic or catabolic pathway can be engineered into a cell, including, e.g., transferase, e.g., transaminase, e.g., d-amino-acid transferase, and/or oxidoreductase, e.g., dehydrogenase, e.g., d-amino-acid dehydrogenase activity.

Similarly, if it is determined that a particular oligonucleotide has no affect at all on the desired trait (e.g., a new transferase, e.g., transaminase, e.g., d-amino-acid transferase, and/or oxidoreductase, e.g., dehydrogenase, e.g., d-amino-acid dehydrogenase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, transferases, e.g., transaminases, e.g., d-amino-acid transferases, and/or oxidoreductases, e.g., dehydrogenases, e.g., d-amino-acid dehydrogenases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences. In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:

a) Primers that include a poly-A head and poly-T tail which when made single-stranded would provide orientation can be utilized. This is accomplished by having the first few bases of the primers made from RNA and hence easily removed RNAseH.

b) Primers that include unique restriction cleavage sites can be utilized. Multiple sites, a battery of unique sequences and repeated synthesis and ligation steps would be required.

c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:

1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

In one aspect (optionally), the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N3-Adenine (See Sun and Hurley, (1992); an N-acetylated or deacetylated 4'-fluoro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5-f]-pyridine ("N-hydroxy-PhIP"). Exemplary means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., transferase, e.g., transaminase, e.g., d-amino-acid transferase, and/or oxidoreductase, e.g., dehydrogenase, e.g., d-amino-acid dehydrogenase) sequences of the invention. The invention also provides additional methods for isolating transferases, e.g., transaminases, e.g., d-amino-acid transferases, and/or oxidoreductases, e.g., dehydrogenases, e.g., d-amino-acid dehydrogenases using the nucleic acids and polypeptides of the invention. In one aspect, the invention provides for variants of a transferase, e.g., transaminase, e.g., d-amino-acid transferase, and/or oxidoreductase, e.g., dehydrogenase, e.g., d-amino-acid dehydrogenase coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate new nucleic acids which encode polypeptides having characteristics which enhance their value in industrial, medical, laboratory (research), pharmaceutical, food and feed and food and feed supplement processing and other applications and processes. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl2, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an E. coli strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence. Recursive ensemble mutagenesis may also be used to generate variants.

Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin, A. P. and Youvan, D. C., PNAS, USA, 89:7811-7815, 1992.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave, S. and Youvan, D. C., Biotechnology Research, 11:1548-1552, 1993. Random and site-directed mutagenesis are described in Arnold, F. H., Current Opinion in Biotechnology, 4:450-455, 1993.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis."

The variants of the polypeptides of the invention may be variants in which one or more of the amino acid residues of the polypeptides of the invention are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the invention includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention and sequences substantially identical thereto. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying transferase-, e.g., transaminase-, e.g., d-amino-acid transferase-, and/or oxidoreductase-, e.g., dehydrogenase-, e.g., d-amino-acid dehydrogenase-encoding nucleic acids to modify codon usage. In one aspect, the invention provides methods for modifying codons in a nucleic acid encoding a transferase, e.g., transaminase, e.g., d-amino-acid transferase, and/or oxidoreductase, e.g., dehydrogenase, e.g., d-amino-acid dehydrogenase to increase or decrease its expression in a host cell. The invention also provides nucleic acids encoding a transferase, e.g., transaminase, e.g., d-amino-acid transferase, and/or oxidoreductase, e.g., dehydrogenase, e.g., d-amino-acid dehydrogenase modified to increase its expression in a host cell, enzymes so modified, and methods of making the modified enzymes. The method comprises identifying a "non-preferred" or a "less preferred" codon in transferase-, e.g., transaminase-, e.g., d-amino-acid transferase-, and/or oxidoreductase-, e.g., dehydrogenase-, e.g., d-amino-acid dehydrogenase-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli* and *Pseudomonas fluorescens*; gram positive bacteria, such as *Lactobacillus gasseri, Lactococcus lactis, Lactococcus cremoris, Bacillus subtilis*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillus niger*, and mammalian cells and cell lines and insect cells and cell lines. Other exemplary host cells include bacterial cells, such as *E. coli, Streptomyces, Bacillus subtilis, Bacillus cereus, Salmonella typhimurium* and various species within the genera *Pseudomonas, Streptomyces* and *Staphylococcus*, fungal cells, such as *Aspergillus*, yeast such as any species of *Pichia, Saccharomyces, Schizosaccharomyces, Schwanniomyces*, including *Pichia pastoris, Saccharomyces cerevisiae*, or *Schizosaccharomyces pombe*, insect cells such as *Drosophila* S2 and *Spodoptera* Sf9, animal cells such as CHO, COS or Bowes melanoma and adenoviruses. The selection of an appropriate host is within the abilities of those skilled in the art. Thus, the invention also includes nucleic acids and polypeptides optimized for expression in these organisms and species.

For example, the codons of a nucleic acid encoding a transferase, e.g., transaminase, e.g., d-amino-acid transferase, and/or oxidoreductase, e.g., dehydrogenase, e.g., d-amino-acid dehydrogenase isolated from a bacterial cell are modified such that the nucleic acid is optimally expressed in a bacterial cell different from the bacteria from which the transferase, e.g., transaminase, e.g., d-amino-acid transferase, and/or oxidoreductase, e.g., dehydrogenase, e.g., d-amino-acid dehydrogenase was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., a transferase, e.g., transaminase, e.g., d-amino-acid transferase, and/or oxidoreductase, e.g., dehydrogenase, e.g., d-amino-acid dehydrogenase), an expression cassette or vector or a transfected or transformed cell of the invention. The invention also provides methods of making and using these transgenic non-human animals.

The transgenic non-human animals can be, e.g., goats, rabbits, sheep, pigs, cows, rats, horses, dogs, fish and mice, comprising the nucleic acids of the invention. These animals can be used, e.g., as in vivo models to study transferase, e.g., transaminase, e.g., d-amino-acid transferase, and/or oxidoreductase, e.g., dehydrogenase, e.g., d-amino-acid dehydrogenase activity, or, as models to screen for agents that change the transferase, e.g., transaminase, e.g., d-amino-acid transferase, and/or oxidoreductase, e.g., dehydrogenase, e.g., d-amino-acid dehydrogenase activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs, chickens, goats, fish and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a transferase, e.g., transaminase, e.g., d-amino-acid transferase, and/or oxidoreductase, e.g., dehydrogenase, e.g., d-amino-acid dehydrogenase of the invention, or, a fusion protein comprising a transferase, e.g., transaminase, e.g., d-amino-acid transferase, and/or oxidoreductase, e.g., dehydrogenase, e.g., d-amino-acid dehydrogenase of the invention.

Transgenic Plants and Seeds

The invention provides transgenic plants and seeds comprising a nucleic acid, a polypeptide (e.g., a transferase, e.g., transaminase, e.g., d-amino-acid transferase, and/or oxidoreductase, e.g., dehydrogenase, e.g., d-amino-acid dehydrogenase), an expression cassette or vector or a transfected or transformed cell of the invention. The invention also provides plant products or byproducts, e.g., fruits, oils, seeds, leaves, extracts and the like, including any plant part, comprising a nucleic acid and/or a polypeptide (e.g., a transferase, e.g., transaminase, e.g., d-amino-acid transferase, and/or oxidoreductase, e.g., dehydrogenase, e.g., d-amino-acid dehydrogenase) of the invention, e.g., wherein the nucleic acid or polypeptide of the invention is heterologous to the plant, plant part, seed etc. The transgenic plant (which includes plant parts, fruits, seeds etc.) can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's transferase, e.g., transaminase, e.g., d-amino-acid transferase, and/or oxidoreductase, e.g., dehydrogenase, e.g., d-amino-acid dehydrogenase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of a transferase, e.g., transaminase, e.g., d-amino-acid transferase, and/or oxidoreductase, e.g., dehydrogenase, e.g., d-amino-acid dehydrogenase. The can change transferase, e.g., transaminase, e.g., d-amino-acid transferase, and/or oxidoreductase, e.g., dehydrogenase, e.g., d-amino-acid dehydrogenase activity in a plant. Alternatively, a transferase, e.g., transaminase, e.g., d-amino-acid transferase, and/or oxidoreductase, e.g., dehydrogenase, e.g., d-amino-acid dehydrogenase of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, in one aspect (optionally), marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, and can rely on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a transferase, e.g., transaminase, e.g., d-amino-acid transferase, and/or oxidoreductase, e.g., dehydrogenase, e.g., d-amino-acid dehydrogenase) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*. Transgenic plants and seeds of the invention can be any monocot or dicot, e.g., a monocot corn, sugarcane, rice, wheat, barley, switchgrass or *Miscanthus*; or a dicot oilseed crop, soy, canola, rapeseed, flax, cotton, palm oil, sugar beet, peanut, tree, poplar or lupine.

In alternative embodiments, the nucleic acids of the invention are expressed in plants (and/or their seeds) which contain fiber cells, including, e.g., cotton, silk cotton tree (Kapok, *Ceiba pentandra*), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense*, and *G. hirsutum*.

The invention also provides for transgenic plants (and/or their seeds) to be used for producing large amounts of the polypeptides (e.g., a transferase, e.g., transaminase, e.g., d-amino-acid transferase, and/or oxidoreductase, e.g., dehydrogenase, e.g., d-amino-acid dehydrogenase or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants (and/or their seeds) of the invention by detecting the increase or decrease of transgene mRNA or protein in transgenic plants. Means for detecting and quantitation of mRNAs or proteins are well known in the art.

Polypeptides and Peptides

In one aspect, the invention provides isolated, synthetic or recombinant polypeptides and peptides having transferase activity, e.g., transaminase activity, e.g., d-amino-acid transferase activity, and/or oxidoreductase activity, e.g., dehydrogenase activity, e.g., d-amino-acid dehydrogenase activity, or polypeptides and peptides capable of generating an antibody that specifically binds to a transferase, e.g., a transaminase, e.g., a d-amino-acid transferase, and/or an oxidoreductase, e.g., a dehydrogenase, e.g., a d-amino-acid dehydrogenase, including an enzyme of this invention, including the amino acid sequences of the invention, which include those having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, or 100% (complete) sequence identity to an exemplary polypeptide of the invention (as defined above, including SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976), including the amino acid sequences described herein, including in Tables 1, 2, 3, 46, 47 and 53, and the Sequence Listing (all of these amino acid sequences are "exemplary enzymes/polypeptides of the invention"), and enzymatically active subsequences (fragments) thereof; and the nucleic acids that encode all of these amino acid sequences are nucleic acid (polynucleotide) sequences of the invention.

In one aspect, the invention provides chimeric enzymes, including a transferase, e.g., a transaminase, e.g., a d-amino-acid transferase, and/or an oxidoreductase, e.g., a dehydrogenase, e.g., a d-amino-acid dehydrogenase, having heterologous binding domains, e.g., for use in the processes of the invention and in various industrial, medical, pharmaceutical, research, food and feed and food and feed supplement processing and other applications. For example, in one aspect the invention provides enzymes, e.g., transferases, e.g., transaminases, e.g., d-amino-acid transferases, and/or oxidoreductases, e.g., dehydrogenases, e.g., d-amino-acid dehydrogenases comprising one or more binding domain of an enzyme of the invention. In another aspect, binding domains, between different enzymes of the invention can be swapped; or, alternatively, one or more binding domains of one or more enzymes of the invention can be spliced into an enzyme, e.g., a transferase, e.g., transaminase, e.g., d-amino-acid transferase, and/or oxidoreductase, e.g., dehydrogenase, e.g., d-amino-acid dehydrogenase. In one aspect of the invention, the binding domains are selected from a NAD, a NAD(P), a calcium, a thiamine, a FAD, a zinc, a DNA and/or a lipoyl binding domain.

The invention further provides chimeric enzymes having heterologous, non-natural substrates; including chimeric enzymes having multiple substrates by nature of their "spliced-in" heterologous binding domains—thus giving the chimeric enzyme new specificity or enhanced binding. The heterologous binding domains of the chimeric enzymes of the invention can be designed to be modular, i.e., to be appended to a catalytic module or catalytic domain (e.g., an active site), which also can be heterologous or can be homologous to the enzyme.

Utilization of just the catalytic module of a transferase, e.g., a transaminase, e.g., a d-amino-acid transferase, and/or an oxidoreductase, e.g., a dehydrogenase, e.g., a d-amino-acid dehydrogenase (e.g., an enzyme of the invention) has been shown to be effective. Thus, the invention provides peptides and polypeptides consisting of, or comprising, modular binding domains/active site modules, which can be homologously paired or joined as chimeric (heterologous) active site-binding module pairs. Thus, these chimeric polypeptides/peptides of the invention can be used to improve or alter the performance of an individual enzyme, e.g., a transferase, e.g., a transaminase, e.g., a d-amino-acid transferase, and/or an oxidoreductase, e.g., a dehydrogenase, e.g., a d-amino-acid dehydrogenase enzyme. A chimeric catalytic module of the invention (comprising, e.g., at least one binding domain of the invention) can be designed to target the enzyme to particular regions of a substrate. For example, in one aspect, this is achieved by making fusions of the transferase, e.g., transaminase, e.g., d-amino-acid transferase, and/or oxidoreductase, e.g., dehydrogenase, e.g., d-amino-acid dehydrogenase and various binding domains (either a transferase, e.g., transaminase, e.g., d-amino-acid transferase, and/or oxidoreductase, e.g., dehydrogenase, e.g., d-amino-acid dehydrogenase of the invention with a heterologous binding domain, or, a binding domain of the invention with another enzyme, e.g., a transferase, e.g., transaminase, e.g., d-amino-acid transferase, and/or oxidoreductase, e.g., dehydrogenase, e.g., d-amino-acid dehydrogenase.

Thus, the invention provides chimeric transferases, e.g., transaminases, e.g., d-amino-acid transferases, and/or oxidoreductases, e.g., dehydrogenases, e.g., d-amino-acid dehydrogenases, e.g., a fusion of a transaminase and/or a dehydrogenase with different (e.g., heterologous) binding domains. In one aspect, the chimeric transferases, e.g., transaminases, e.g., d-amino-acid transferases, and/or oxidoreductases, e.g., dehydrogenases, e.g., d-amino-acid dehydrogenases comprise an enzyme of the invention. In one aspect, the chimeric enzyme comprises fusions of different binding domains. The invention also provides methods comprising recombining different binding domains with different transferases, e.g., transaminases, e.g., d-amino-acid transferases, and/or oxidoreductases, e.g., dehydrogenases, e.g., d-amino-acid dehydrogenases (e.g., binding domains of the invention and/or transferases, e.g., transaminases, e.g., d-amino-acid transferases, and/or oxidoreductases, e.g., dehydrogenases, e.g., d-amino-acid dehydrogenases of the invention) and screening the resultant chimerics to find the best combination for a particular application or substrate.

Other variations also are within the scope of this invention, e.g., where one, two, three, four or five or more residues are removed from the carboxy- or amino-terminal ends of any polypeptide of the invention. Another variation includes modifying any residue to increase or decrease pI of a polypeptide, e.g., removing or modifying (e.g., to another amino acid) a glutamate. This method was used as a general scheme for improving the enzyme's properties without creating regulatory issues since no amino acids are mutated; and this general scheme can be used with any polypeptide of the invention.

The invention provides isolated, synthetic or recombinant polypeptides having transferase, e.g., transaminase, e.g., d-amino-acid transferase, and/or oxidoreductase, e.g., dehydrogenase, e.g., d-amino-acid dehydrogenase activity, wherein the polypeptide has a sequence modification of any polypeptide of the invention, including any exemplary amino acid sequence of the invention, including SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:220 with one, several or all of the modifications of Table 46 or Table 55, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974 and/or SEQ ID NO:976, including the sequences described herein and in Tables 1, 2 and 3, and the Sequence Listing (all of these sequences are "exemplary enzymes/polypeptides of the invention"), and enzymatically active subsequences (fragments) thereof. The sequence change(s) can also comprise any amino acid modification to change the pI of a polypeptide, e.g., deletion or modification of a glutamate, or changing from a glutamate to another residue.

The invention further provides isolated, synthetic or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary sequence of the invention.

In one aspect, the polypeptide has a transferase activity, e.g., transaminase activity, e.g., d-amino-acid transferase activity, and/or oxidoreductase activity, e.g., dehydrogenase activity, e.g., d-amino-acid dehydrogenase activity, and/or catalyze the transfer of a chemical group, catalyze transamination, catalyze the reaction: D-alanine+2-oxoglutarate<=>pyruvate+D-glutamate, and/or catalyze an oxidation-reduction reaction, catalyze the removal of hydrogen atoms, and/or catalyze the reaction: D-amino acid+$H_2O$+acceptor<=>a 2-oxo acid+$NH_3$+reduced acceptor.

Any transferase activity, e.g., transaminase activity, e.g., d-amino-acid transferase activity, and/or oxidoreductase activity, e.g., dehydrogenase activity, e.g., d-amino-acid dehydrogenase assay known in the art can be used to determine if a polypeptide has transferase activity, e.g., transaminase activity, e.g., d-amino-acid transferase activity, and/or oxidoreductase activity, e.g., dehydrogenase activity, e.g., d-amino-acid dehydrogenase activity and is within scope of the invention. For example, Lee, et. al. (AEM. 2006 February.

72(2):1588-1594) describes calculating pyruvate formation rate using a coupling assay with lactate dehydrogenase. In another example, Mayer (Journal of Biomolecular Screening, Vol. 7, No. 2, 135-140 (2002)) describes a colorimetric assay which uses Nitroblue tetrazolium (NBT) and phenazine methosulfate (PMS) in reaction with NADPH produced by dehydrogenases to produce an insoluble blue-purple formazan.

The polypeptides of the invention include transferases, e.g., transaminases, e.g., d-amino-acid transferases, and/or oxidoreductases, e.g., dehydrogenases, e.g., d-amino-acid dehydrogenases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include transferases, e.g., transaminases, e.g., d-amino-acid transferases, and/or oxidoreductases, e.g., dehydrogenases, e.g., d-amino-acid dehydrogenases inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the transferase, e.g., transaminase, e.g., d-amino-acid transferase, and/or oxidoreductase, e.g., dehydrogenase, e.g., d-amino-acid dehydrogenase.

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated, synthetic or recombinant signal sequences, prepro sequences and catalytic domains (e.g., "active sites") comprising sequences of the invention.

The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as a transferase, e.g., transaminase, e.g., d-amino-acid transferase, and/or oxidoreductase, e.g., dehydrogenase, e.g., d-amino-acid dehydrogenase; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary transferase, e.g., transaminase, e.g., d-amino-acid transferase, and/or oxidoreductase, e.g., dehydrogenase, e.g., d-amino-acid dehydrogenase of the invention.

Peptides of the invention (e.g., a subsequence of an exemplary polypeptide of the invention) can be useful as, e.g., labeling probes, antigens, toleragens, motifs, active sites (e.g., "catalytic domains"), signal sequences and/or prepro domains.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques that are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphytidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, phosphorylation, prenylation, racemization, selenoylation, sulfation and transfer-RNA mediated addition of amino acids to protein such as arginylation. (See Creighton, T. E., *Proteins—Structure and Molecular Properties 2nd Ed.*, W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

"Recombinant" polypeptides or proteins refer to polypeptides or proteins produced by recombinant DNA techniques; i.e., produced from cells transformed by an exogenous DNA construct encoding the desired polypeptide or protein. "Synthetic" nucleic acids (including oligonucleotides), polypeptides or proteins of the invention include those prepared by any chemical synthesis, e.g., as described, below. Solid-phase chemical peptide synthesis methods can also be used to synthesize the polypeptide or fragments of the invention. Such method have been known in the art since the early 1960's (Merrifield, R. B., *J. Am. Chem. Soc.*, 85:2149-2154, 1963) (See also Stewart, J. M. and Young, J. D., *Solid Phase Peptide Synthesis*, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. Sci., USA*, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A automated peptide synthesizer. Such equipment provides ready access to the peptides of the invention, either by direct synthesis or by synthesis of a series of fragments that can be coupled using other known techniques.

"Fragments" as used herein are a portion of a naturally occurring protein which can exist in at least two different conformations. Fragments can have the same or substantially the same amino acid sequence as the naturally occurring protein. "Substantially the same" means that an amino acid sequence is largely, but not entirely, the same, but retains at least one functional activity of the sequence to which it is related. In general two amino acid sequences are "substantially the same" or "substantially homologous" if they are at least about 85% identical. Fragments which have different three dimensional structures as the naturally occurring protein are also included. An example of this, is a "pro-form" molecule, such as a low activity proprotein that can be modified by cleavage to produce a mature enzyme with significantly higher activity.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has a transferase, e.g., transaminase, e.g., d-amino-acid transferase, and/or oxidoreductase, e.g., dehydrogenase, e.g., d-amino-acid dehydrogenase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—$CH_2$— for —C(=O)—NH—), aminomethylene ($CH_2$—NH), ethylene, olefin (CH=CH), ether ($CH_2$—O), thioether ($CH_2$—S), tetrazole ($CN_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2,3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl)carbodiimide or 1-ethyl-3(4-azonia-4,4-dimetholpentyl)carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzenesulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The invention includes transferases, e.g., transaminases, e.g., d-amino-acid transferases, and/or oxidoreductases, e.g., dehydrogenases, e.g., d-amino-acid dehydrogenases of the invention with and without signal. The polypeptide comprising a signal sequence of the invention can be a transferase, e.g., transaminase, e.g., d-amino-acid transferase, and/or oxidoreductase, e.g., dehydrogenase, e.g., d-amino-acid dehydrogenase of the invention or another transferase, e.g., transaminase, e.g., d-amino-acid transferase, and/or oxidoreductase, e.g., dehydrogenase, e.g., d-amino-acid dehydrogenase or another enzyme or other polypeptide.

The invention includes immobilized transferases, e.g., transaminases, e.g., d-amino-acid transferases, and/or oxidoreductases, e.g., dehydrogenases, e.g., d-amino-acid dehydrogenases and anti-transferase, e.g., anti-transaminase, e.g., anti-d-amino-acid transferase, and/or anti-oxidoreductase, e.g., anti-dehydrogenase, e.g., anti-d-amino-acid dehydrogenase antibodies and fragments thereof. The invention provides methods for inhibiting transferase, e.g., transaminase, e.g., d-amino-acid transferase, and/or oxidoreductase, e.g., dehydrogenase, e.g., d-amino-acid dehydrogenase activity, e.g., using dominant negative mutants or anti-transferase, e.g., anti-transaminase, e.g., anti-d-amino-acid transferase, and/or anti-oxidoreductase, e.g., anti-dehydrogenase, e.g., anti-d-amino-acid dehydrogenase antibodies of the invention. The invention includes heterocomplexes, e.g., fusion proteins, heterodimers, etc., comprising the transferases, e.g., transaminases, e.g., d-amino-acid transferases, and/or oxidoreductases, e.g., dehydrogenases, e.g., d-amino-acid dehydrogenases of the invention.

Polypeptides of the invention can have a transferase, e.g., transaminase, e.g., d-amino-acid transferase, and/or oxidoreductase, e.g., dehydrogenase, e.g., d-amino-acid dehydrogenase activity under various conditions, e.g., extremes in pH and/or temperature, oxidizing agents, and the like. The invention provides methods leading to alternative transferase, e.g., transaminase, e.g., d-amino-acid transferase, and/or oxidoreductase, e.g., dehydrogenase, e.g., d-amino-acid dehydrogenase preparations with different catalytic efficiencies and stabilities, e.g., towards temperature, oxidizing agents and changing wash conditions. In one aspect, transferase, e.g., transaminase, e.g., d-amino-acid transferase, and/or oxidoreductase, e.g., dehydrogenase, e.g., d-amino-acid dehydrogenase variants can be produced using techniques of site-directed mutagenesis and/or random mutagenesis. In one aspect, directed evolution can be used to produce a great variety of transferase, e.g., transaminase, e.g., d-amino-acid transferase, and/or oxidoreductase, e.g., dehydrogenase, e.g., d-amino-acid dehydrogenase variants with alternative specificities and stability.

The proteins of the invention are also useful as research reagents to identify transferase, e.g., transaminase, e.g., d-amino-acid transferase, and/or oxidoreductase, e.g., dehydrogenase, e.g., d-amino-acid dehydrogenase modulators, e.g., activators or inhibitors of transferase, e.g., transaminase, e.g., d-amino-acid transferase, and/or oxidoreductase, e.g., dehydrogenase, e.g., d-amino-acid dehydrogenase activity. Briefly, test samples (compounds, broths, extracts, and the like) are added to transferase, e.g., transaminase, e.g., d-amino-acid transferase, and/or oxidoreductase, e.g., dehydrogenase, e.g., d-amino-acid dehydrogenase assays to determine their ability to inhibit substrate cleavage. Inhibitors identified in this way can be used in industry and research to reduce or prevent undesired proteolysis. Inhibitors can be combined to increase the spectrum of activity.

The enzymes of the invention are also useful as research reagents to digest proteins or in protein sequencing. For example, the transferases, e.g., transaminases, e.g., d-amino-acid transferases, and/or oxidoreductases, e.g., dehydrogenases, e.g., d-amino-acid dehydrogenases may be used to break polypeptides into smaller fragments for sequencing using, e.g. an automated sequencer.

The invention also provides methods of discovering new transferases, e.g., transaminases, e.g., d-amino-acid transferases, and/or oxidoreductases, e.g., dehydrogenases, e.g., d-amino-acid dehydrogenases using the nucleic acids, polypeptides and antibodies of the invention. In one aspect, phagemid libraries are screened for expression-based discovery of transferases, e.g., transaminases, e.g., d-amino-acid transferases, and/or oxidoreductases, e.g., dehydrogenases, e.g., d-amino-acid dehydrogenases. In another aspect, lambda phage libraries are screened for expression-based discovery of transferases, e.g., transaminases, e.g., d-amino-acid transferases, and/or oxidoreductases, e.g., dehydrogenases, e.g., d-amino-acid dehydrogenases. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

Another aspect of the invention is an isolated or purified polypeptide comprising the sequence of one of the invention and sequences substantially identical thereto, or fragments comprising at least about 5, 10, 15, 20, 25, 30, 35, 40, 50, 75, 100, or 150 consecutive amino acids thereof. As discussed above, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for amplifying expression.

Another aspect of the invention is polypeptides or fragments thereof which have at least about 50%, at least about 55%, at least about 60%, at least about 65%, at least about 70%, at least about 75%, at least about 80%, at least about 85%, at least about 90%, at least about 95%, or more than about 95% homology to one of the polypeptides of the invention and sequences substantially identical thereto, or a fragment comprising at least 5, 10, 15, 20, 25, 30, 35, 40, 50, 75, 100, or 150 consecutive amino acids thereof. Homology may be determined using any of the programs described above which aligns the polypeptides or fragments being compared and determines the extent of amino acid identity or similarity between them. It will be appreciated that amino acid "homology" includes conservative amino acid substitutions such as those described above.

The polypeptides or fragments having homology to one of the polypeptides of the invention, or a fragment comprising at least about 5, 10, 15, 20, 25, 30, 35, 40, 50, 75, 100, or 150 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by gel electrophoresis and/or microsequencing. The sequence of the prospective homologous polypeptide or fragment can be compared to one of the polypeptides of the invention, or a fragment comprising at least about 5, 10, 15, 20, 25, 30, 35, 40, 50, 75, 100, or 150 consecutive amino acids thereof using any of the programs described above.

Another aspect of the invention is an assay for identifying fragments or variants of The invention, which retain the enzymatic function of the polypeptides of the invention. For example the fragments or variants of said polypeptides, may be used to catalyze biochemical reactions, which indicate that the fragment or variant retains the enzymatic activity of the polypeptides of the invention.

The assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is in one aspect (optionally) repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Transaminase and/or Oxidoreductase Signal Sequences, Prepro and Catalytic Domains The invention provides transferase, e.g., transaminase, e.g., d-amino-acid transferase, and/or oxidoreductase, e.g., dehydrogenase, e.g., d-amino-acid dehydrogenase signal sequences (e.g., signal peptides (SPs)), prepro domains and catalytic domains (CDs). The SPs, prepro domains and/or CDs of the invention can be isolated, synthetic or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention). In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44, 1 to 45, 1 to 46, 1 to 47, 1 to 48, 1 to 49 or 1 to 50, of a polypeptide of the invention.

The transferase, e.g., transaminase, e.g., d-amino-acid transferase, and/or oxidoreductase, e.g., dehydrogenase, e.g., d-amino-acid dehydrogenase signal sequences (SPs) and/or prepro sequences of the invention can be isolated peptides, or, sequences joined to another transferase, e.g., transaminase, e.g., d-amino-acid transferase, and/or oxidoreductase, e.g., dehydrogenase, e.g., d-amino-acid dehydrogenase or a non-transferase, e.g., non-transaminase, e.g., non-d-amino-acid transferase, and/or non-oxidoreductase, e.g., non-dehydrogenase, e.g., non-d-amino-acid dehydrogenase polypeptide, e.g., as a fusion (chimeric) protein. In one aspect, the invention provides polypeptides comprising transferase, e.g., transaminase, e.g., d-amino-acid transferase, and/or oxidoreductase, e.g., dehydrogenase, e.g., d-amino-acid dehydrogenase signal sequences of the invention. In one aspect, polypeptides comprising transferase, e.g., transaminase, e.g., d-amino-acid transferase, and/or oxidoreductase, e.g., dehydrogenase, e.g., d-amino-acid dehydrogenase signal sequences SPs and/or prepro of the invention comprise sequences heterologous to a transferase, e.g., transaminase, e.g., d-amino-acid transferase, and/or oxidoreductase, e.g., dehydrogenase, e.g., d-amino-acid dehydrogenase of the invention (e.g., a fusion protein comprising an SP and/or prepro of the invention and sequences from another transferase, e.g., transaminase, e.g., d-amino-acid transferase, and/or oxidoreductase, e.g., dehydrogenase, e.g., d-amino-acid dehydrogenase or a non-transferase, e.g., non-transaminase, e.g., non-d-amino-acid transferase, and/or non-oxidoreductase, e.g., non-dehydrogenase, e.g., non-d-amino-acid dehydrogenase polypeptide protein). In one aspect, the invention provides transferase, e.g., transaminase, e.g., d-amino-acid transferase, and/or oxidoreductase, e.g., dehydrogenase, e.g., d-amino-acid dehydrogenase of the invention with heterologous SPs and/or prepro sequences, e.g., sequences with a yeast signal sequence. A transferase, e.g., transaminase, e.g., d-amino-acid transferase, and/or oxidoreductase, e.g., dehydrogenase, e.g., d-amino-acid dehydrogenase of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel transferase, e.g., transaminase, e.g., d-amino-acid transferase, and/or oxidoreductase, e.g., dehydrogenase, e.g., d-amino-acid dehydrogenase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from between about 10 to 50 amino acid residues. Various methods of recognition of signal sequences are known to those of skill in the art. For example, in one aspect, novel transferase, e.g., transaminase, e.g., d-amino-acid transferase, and/or oxidoreductase, e.g., dehydrogenase, e.g., d-amino-acid dehydrogenase signal peptides are identified by a method referred to as SignalP. SignalP uses a combined neural network which recognizes both signal peptides and their cleavage sites; see, e.g., Nielsen (1997) "Identification of prokaryotic and eukaryotic signal peptides and prediction of their cleavage sites." Protein Engineering 10:1-6.

It should be understood that in some aspects transferases, e.g., transaminases, e.g., d-amino-acid transferases, and/or oxidoreductases, e.g., dehydrogenases, e.g., d-amino-acid dehydrogenases of the invention may not have SPs and/or prepro sequences, or "domains." In one aspect, the invention provides the transferases, e.g., transaminases, e.g., d-amino-acid transferases, and/or oxidoreductases, e.g., dehydrogenases, e.g., d-amino-acid dehydrogenases of the invention lacking all or part of an SP and/or a prepro domain. In one aspect, the invention provides a nucleic acid sequence encoding a signal sequence (SP) and/or prepro from one transferase, e.g., transaminase, e.g., d-amino-acid transferase, and/or oxidoreductase, e.g., dehydrogenase, e.g., d-amino-acid dehydrogenase operably linked to a nucleic acid sequence of a different transferase, e.g., transaminase, e.g., d-amino-acid transferase, and/or oxidoreductase, e.g., dehydrogenase, e.g., d-amino-acid dehydrogenase or, in one aspect (optionally), a signal sequence (SPs) and/or prepro domain from a non-transferase, e.g., non-transaminase, e.g., non-d-amino-acid transferase, and/or non-oxidoreductase, e.g., non-dehydrogenase, e.g., non-d-amino-acid dehydrogenase protein may be desired.

The invention also provides isolated, synthetic or recombinant polypeptides comprising signal sequences (SPs), prepro domain and/or catalytic domains (CDs) of the invention and heterologous sequences. The heterologous sequences are sequences not naturally associated (e.g., to a transferase, e.g., transaminase, e.g., d-amino-acid transferase, and/or oxidoreductase, e.g., dehydrogenase, e.g., d-amino-acid dehydrogenase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated, synthetic or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a transferase, e.g., transaminase, e.g., d-amino-acid transferase, and/or oxidoreductase, e.g., dehydrogenase, e.g., d-amino-acid dehydrogenase sequence). Similarly in one aspect, the invention provides isolated, synthetic or recombinant nucleic acids encoding these polypeptides. Thus, in one aspect, the isolated, synthetic or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Transferases and/or Oxidoreductases and Peptide Libraries

In one aspect, the invention provides hybrid transferases, e.g., transaminases, e.g., d-amino-acid transferases, and/or oxidoreductases, e.g., dehydrogenases, e.g., d-amino-acid dehydrogenases and fusion proteins, including peptide libraries, comprising sequences of the invention. The peptide libraries of the invention can be used to isolate peptide modulators (e.g., activators or inhibitors) of targets, such as transferase, e.g., transaminase, e.g., d-amino-acid transferase, and/or oxidoreductase, e.g., dehydrogenase, e.g., d-amino-acid dehydrogenase substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of transferases, e.g., transaminases, e.g., d-amino-acid transferases, and/or oxidoreductases, e.g., dehydrogenases, e.g., d-amino-acid dehydrogenases of the invention and other peptides, including known and random peptides. They can be fused in such a manner that the structure of the transferases, e.g., transaminases, e.g., d-amino-acid transferases, and/or oxidoreductases, e.g., dehydrogenases, e.g., d-amino-acid dehydrogenases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a transferase, e.g., transaminase, e.g., d-amino-acid transferase, and/or oxidoreductase, e.g., dehydrogenase, e.g., d-amino-acid dehydrogenase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed transferase, e.g., transaminase, e.g., d-amino-acid transferase, and/or oxidoreductase, e.g., dehydrogenase, e.g., d-amino-acid dehydrogenase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of transaminase and/or oxidoreductase activity. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides transferases, e.g., transaminases, e.g., d-amino-acid transferases, and/or oxidoreductases, e.g., dehydrogenases, e.g., d-amino-acid dehydrogenases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. transferase, e.g., transaminase, e.g., d-amino-acid transferase, and/or oxidoreductase, e.g., dehydrogenase, e.g., d-amino-acid dehydrogenase activity) although variants can be selected to modify the characteristics of the transferases, e.g., transaminases, e.g., d-amino-acid transferases, and/or oxidoreductases, e.g., dehydrogenases, e.g., d-amino-acid dehydrogenases as needed.

In one aspect, transferases, e.g., transaminases, e.g., d-amino-acid transferases, and/or oxidoreductases, e.g., dehydrogenases, e.g., d-amino-acid dehydrogenases of the invention comprise epitopes or purification tags, signal sequences or other fusion sequences, etc. In one aspect, the transferases, e.g., transaminases, e.g., d-amino-acid transferases, and/or oxidoreductases, e.g., dehydrogenases, e.g., d-amino-acid dehydrogenases of the invention can be fused to a random peptide to form a fusion polypeptide. By "fused" or "operably linked" herein is meant that the random peptide and the transferase, e.g., transaminase, e.g., d-amino-acid transferase, and/or oxidoreductase, e.g., dehydrogenase, e.g., d-amino-acid dehydrogenase are linked together, in such a manner as to minimize the disruption to the stability of the structure, e.g., it retains transferase, e.g., transaminase, e.g., d-amino-acid transferase, and/or oxidoreductase, e.g., dehydrogenase, e.g., d-amino-acid dehydrogenase activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Transferases, e.g., transaminases, e.g., d-amino-acid transferases, and/or oxidoreductases, e.g., dehydrogenases, e.g., d-amino-acid dehydrogenases are multidomain enzymes that consist in one aspect (optionally) of a signal peptide, a binding domain, a catalytic domain, a linker and/or another catalytic domain.

The invention provides a means for generating chimeric polypeptides which may encode biologically active hybrid polypeptides (e.g., hybrid transferases, e.g., transaminases, e.g., d-amino-acid transferases, and/or oxidoreductases, e.g., dehydrogenases, e.g., d-amino-acid dehydrogenases). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

A hybrid polypeptide resulting from the method of the invention may exhibit specialized enzyme activity not displayed in the original enzymes. For example, following recombination and/or reductive reassortment of polynucleotides encoding transferase, e.g., transaminase, e.g., d-amino-acid transferase, and/or oxidoreductase, e.g., dehydrogenase, e.g., d-amino-acid dehydrogenase activities, the resulting hybrid polypeptide encoded by a hybrid polynucleotide can be screened for specialized transferase, e.g., transaminase, e.g., d-amino-acid transferase, and/or oxidoreductase, e.g., dehydrogenase, e.g., d-amino-acid dehydrogenase activities obtained from each of the original enzymes, i.e. the type of bond on which the transferase, e.g., transaminase, e.g., d-amino-acid transferase, and/or oxidoreductase, e.g., dehydrogenase, e.g., d-amino-acid dehydrogenase acts and the temperature at which the transferase, e.g., transaminase, e.g., d-amino-acid transferase, and/or oxidoreductase, e.g., dehydrogenase, e.g., d-amino-acid dehydrogenase functions. Thus, for example, the transferase, e.g., transaminase, e.g., d-amino-acid transferase, and/or oxidoreductase, e.g., dehydrogenase, e.g., d-amino-acid dehydrogenase may be screened to ascertain those chemical functionalities which distinguish the hybrid transferase, e.g., transaminase, e.g., d-amino-acid transferase, and/or oxidoreductase, e.g., dehydrogenase, e.g., d-amino-acid dehydrogenase from the original transferases, e.g., transaminases, e.g., d-amino-acid transferases, and/or oxidoreductases, e.g., dehydrogenases, e.g., d-amino-acid dehydrogenases, for example, differences in activity at various temperatures, pH or salt concentration.

Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., *Molecular Cloning: A Laboratory Manual, 2nd Ed.*, Cold Spring Harbor Laboratory Press (1989)). In another aspect, the enzymes of the invention are subclones. Such subclones may differ from the parent clone by, for example, length, a mutation, a tag or a label.

The microorganisms from which the polynucleotide may be prepared include prokaryotic microorganisms, such as Eubacteria and Archaebacteria and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are preferably already in a vector which includes appropriate control sequences. The host cell can be a higher eukaryotic cell, such as a mammalian cell, or a lower eukaryotic cell, such as a yeast cell, or preferably, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of E. coli. This f-factor of E. coli is a plasmid which affects high-frequency transfer of itself during conjugation and is ideal to achieve and stably propagate large DNA fragments, such as gene clusters from mixed microbial samples. One aspect of the invention is to use cloning vectors, referred to as "fosmids" or bacterial artificial chromosome (BAC) vectors. These are derived from E. coli f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., *Molecular Cloning: A Laboratory Manual, 2nd Ed.*, Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Therefore, in a one aspect, the invention relates to a method for producing a biologically active hybrid polypeptide and screening such a polypeptide for enhanced activity by:

1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Methods for screening for various enzyme activities are known to those of skill in the art and are discussed throughout the present specification. Such methods may be employed when isolating the polypeptides and polynucleotides of the invention.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for transferase, e.g., transaminase, e.g., d-amino-acid transferase, and/or oxidoreductase, e.g., dehydrogenase, e.g., d-amino-acid dehydrogenase activity, to screen compounds as potential modulators, e.g., activators or inhibitors, of a transferase, e.g., transaminase, e.g., d-amino-acid transferase, and/or oxidoreductase, e.g., dehydrogenase, e.g., d-amino-acid dehydrogenase activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids and/or polypeptides of the invention can be immobilized to or applied to an array, e.g., a "biochip". Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a transferase, e.g., transaminase, e.g., d-amino-acid transferase, and/or oxidoreductase, e.g., dehydrogenase, e.g., d-amino-acid dehydrogenase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated, synthetic or recombinant antibodies that specifically bind to a transferase, e.g., transaminase, e.g., d-amino-acid transferase, and/or oxidoreductase, e.g., dehydrogenase, e.g., d-amino-acid dehydrogenase of the invention. These antibodies can be used to isolate, identify or quantify a transferase, e.g., transaminase, e.g., d-amino-acid transferase, and/or oxidoreductase, e.g., dehydrogenase, e.g., d-amino-acid dehydrogenase of the invention or related polypeptides. These antibodies can be used to isolate other polypeptides within the scope the invention or other related ansferases, e.g., transaminases, e.g., d-amino-acid transferases, and/or oxidoreductases, e.g., dehydrogenases, e.g., d-amino-acid dehydrogenases. The antibodies can be designed to bind to an active site of a transferase, e.g., transaminase, e.g., d-amino-acid transferase, and/or oxidoreductase, e.g., dehydrogenase, e.g., d-amino-acid dehydrogenase. Thus, the invention provides methods of inhibiting transferases, e.g., transaminases, e.g., d-amino-acid transferases, and/or oxidoreductases, e.g., dehydrogenases, e.g., d-amino-acid dehydrogenases using the antibodies of the invention (see discussion above regarding applications for anti-transferase, e.g., anti-transaminase, e.g., anti-d-amino-acid transferase, and/or anti-oxidoreductase, e.g., anti-dehydrogenase, e.g., anti-d-amino-acid dehydrogenasecompositions of the invention).

The invention provides fragments of the enzymes of the invention, including immunogenic fragments of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of The invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of The invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of The invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of The invention, or fragments comprising at least 5, 10, 15, 20, 25, 30, 35, 40, 50, 75, 100, or 150 or more consecutive amino acids thereof can be obtained by direct injection of the polypeptides into an animal or by administering the polypeptides to an animal, for example, a nonhuman. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of The invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of The invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., transferases, e.g., transaminases, e.g., d-amino-acid transferases, and/or oxidoreductases, e.g., dehydrogenases, e.g., d-amino-acid dehydrogenases) and/or antibodies of the invention. The kits also can contain instructional material teaching the methodologies and industrial, research, medical, pharmaceutical, food and feed and food and feed supplement processing and other applications and processes of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified transferase, e.g., transaminase, e.g., d-amino-acid transferase, and/or oxidoreductase, e.g., dehydrogenase, e.g., d-amino-acid dehydrogenase activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the transferases, e.g., transaminases, e.g., d-amino-acid transferases, and/or oxidoreductases, e.g., dehydrogenases, e.g., d-amino-acid dehydrogenases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a transferase, e.g., transaminase, e.g., d-amino-acid transferase, and/or oxidoreductase, e.g., dehydrogenase, e.g., d-amino-acid dehydrogenase message) or generating new (e.g., transferase, e.g., transaminase, e.g., d-amino-acid transferase, and/or oxidoreductase, e.g., dehydrogenase, e.g., d-amino-acid dehydrogenase) transcripts in a cell. This increased or decreased expression can be traced by testing for the presence of a transferase, e.g., transaminase, e.g., d-amino-acid transferase, and/or oxidoreductase, e.g., dehydrogenase, e.g., d-amino-acid dehydrogenase of the invention or by transferase, e.g., transaminase, e.g., d-amino-acid transferase, and/or oxidoreductase, e.g., dehydrogenase, e.g., d-amino-acid dehydrogenase activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a transferase, e.g., transaminase, e.g., d-amino-acid transferase, and/or oxidoreductase, e.g., dehydrogenase, e.g., d-amino-acid dehydrogenase) or generating new polypeptides in a cell. This increased or decreased expression can be traced by determining the amount of transferase, e.g., transaminase, e.g., d-amino-acid transferase, and/or oxidoreductase, e.g., dehydrogenase, e.g., d-amino-acid dehydrogenase present or by transferase, e.g., transaminase, e.g., d-amino-acid transferase, and/or oxidoreductase, e.g., dehydrogenase, e.g., d-amino-acid dehydrogenase activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immunofluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial, Energy, Pharmaceutical, Medical, Food Processing and Other Applications Polypeptides of the invention can be used in any industrial, agricultural, food and feed and food and feed supplement processing, pharmaceutical (drug), medical, research (laboratory) or other process. The invention provides industrial processes using enzymes of the invention, e.g., in the pharmaceutical or nutrient (diet) supplement industry, the energy industry (e.g., to make "clean" biofuels), in the food and feed industries, e.g., in methods for making food and feed products and food and feed additives. In one aspect, the invention provides processes using enzymes of the invention in the medical industry, e.g., to make pharmaceuticals (drugs), pharmaceutical (drug) precursors or intermediates, or dietary aids or supplements, or food supplements and additives. In addition, the invention provides methods for using the enzymes of the invention in biofuel production, including, e.g., a bioalcohol such as bioethanol, biomethanol, biobutanol or biopropanol, thus comprising a "clean" fuel production.

The transferases of the invention, which can have any transaminase activity, e.g., d-amino-acid transferase or ω-transaminase activity, e.g., catalyzing the conversion of ω-amines to ketones. The transferases of the invention also can have oxidoreductase, e.g., dehydrogenase, e.g., d-amino-acid dehydrogenase activity. An enzyme of the invention can be highly selective catalysts. They can catalyze reactions with exquisite stereo-, regio- and chemo-selectivities that are unparalleled in conventional synthetic chemistry. For example, an enzyme of the invention can have ω-transaminase activity that can comprise catalyzing the conversion of chiral ω-amines to ketones.

Enzymes of the invention can be remarkably versatile. For example, the transferase, e.g., transaminase, e.g., d-amino-acid transferase, and/or oxidoreductase, e.g., dehydrogenase, e.g., d-amino-acid dehydrogenase enzymes of the invention can be "tailored" (e.g., sequence modified, or otherwise modified, e.g., glycosylated) to function in organic solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

In one aspect, the transaminase and/or aminotransferase enzymes of the invention are used in processes in organic synthesis reactions in the manufacture of medicaments, pesticides or intermediates thereof. In one embodiment, the transaminase and/or aminotransferase enzymes of the invention are used as targets for examining protein turnover in response to a pathological or biological process, e.g. liver damage/disease or myocardial infarction. In one exemplary transamination reaction using an enzyme of the invention, an alpha-amino group is transferred to an alpha-carbon atom of an alpha-ketoglutarate generating the corresponding alpha-keto acid analog of the amino acid.

Natural and Unnatural Amino Acid Synthesis

The enzymes of the invention can be used to produce all natural and various unnatural amino acid, including L- and/or D-amino acids, which can be used, e.g., in industrial or pharmaceutical (drug) products and/or pharmaceutical (drug) precursors and/or intermediates, such as sweeteners, antibiotics, peptide enzymes and peptide hormones. For example, alitame (e.g., ACLAME™), tyrocidin A, antinomycin D, penicillin N and cephalosporin C, and cyclosporin A comprise D-alanine and D-phenylalanine, D-valine, D-alpha amino valerate, D-alpha aminoavalerate and D-alanine, respectively, are manufactured using an enzyme of the invention. In one aspect, an enzyme of the invention is used in the conversion of cephalosporin C to Glutaryl-7-aminocephalosporanic acid (GL-7ACA), which is a highly valuable pharmaceutical chemical for the synthesis of cephem antibiotics. In one exemplary method of producing Glutaryl-7-aminocephalosporanic acid from Cephalosporin C by using an aminotransferase of the invention, an enzyme of the invention is added to a substrate mixture comprising Cephalosporin C and a D-amino acceptor, e.g., a pyruvate or an alpha.-ketoglutarate, to form keto-GL-7ACA and D-Alanine or D-glutamate, respectively. The mixture is then reacted with hydrogen peroxide and the Glutaryl-7-amino-cephalosporanic acid is isolated as a product. See, e.g., U.S. Pat. No. 6,337,190.

The invention provides enzymes and processes for making natural and unnatural (non-natural) amino acids. Enzymes of this invention can be used with any natural or unnatural amino acid synthesis process known in the art; for example, in alternative embodiments, processes of the invention, using enzymes of this invention, synthesize natural or unnatural amino acids using methods as described in U.S. Pat. Nos. 6,197,558; 6,180,374; 4,518,692; and 4,826,766. For example, in one aspect the invention provides a method comprising reacting a first amino acid, a keto acid and a transaminase enzyme of this invention under conditions appropriate to produce a second amino acid and pyruvate; reacting the pyruvate with acetolactate synthase under conditions appropriate to produce a compound that does not react with the transaminase enzyme and separating the second amino acid.

In one aspect, enzymes and processes of the invention are used to make tert-leucine, which in turn can be used in drug/pharmaceutical synthetic processes, for example, L-tert-leucine-2-pyridylamide is a useful intermediate for the preparation of matrix metalloproteinase inhibitor compounds, see e.g., EP Patent EP0822186.

Enzymes and processes of the invention can be used to make "unnatural" amino acids such as:
β-amino acids (β 3 and β 2)
homo-amino acids
cyclic amino acids
aromatic amino acids
N-methyl amino acids
Pro and Pyr derivatives
3-substituted Alanine derivatives
Glycine derivatives
Ring-substituted Phe and Tyr Derivatives
Linear Core Amino Acids
Diamino Acids (diamines)
Ornithine
Norleucine
Phenylselenocysteine (see U.S. Pat. App. pub. 20070238152)
Substituted amino acids (e.g., ortho-, para- or meta-substituted alanines, phenyl alanines, tyrosines, etc.)
DAB (2,4-Diaminobutyric Acid)
Alicyclic Amino Acids (e.g., (cis)-3-Aminobicyclo[2.2.1] heptane-2-carboxylic acid; 1-Amino-1-cyclobutanecarboxylic acid; 1-Aminocyclohexanecarboxylic acid purum; cis-2-Amino-1-cyclopentanecarboxylic acid, and the like)
Enzymes and processes of the invention can be used in conjunction with methods for in vivo incorporation of unnatural amino acids, e.g., as described in U.S. Pat. App. pubs. 20070117184; 20060234339; 20060233744; 20050272121; 20050250183; 20030082575.

Detergent, Disinfectant and Cleaning Compositions

The invention provides cleaning compositions, e.g., detergent, disinfectant or cleanser (cleaning or cleansing) compositions, e.g. for cleaning fabrics, dishwashing, laundry, oral cleaning, denture cleaning, and contact lenses, comprising one or more polypeptides (e.g., transferases, e.g., transaminases, e.g., d-amino-acid transferases, and/or oxidoreductases, e.g., dehydrogenases, e.g., d-amino-acid dehydrogenases) of the invention, and methods of making and using these compositions. The invention incorporates all methods of making and using detergent, disinfectant or cleanser compositions, see, e.g., U.S. Pat. Nos. 6,413,928; 6,399,561; 6,365, 561; 6,380,147. The detergent, disinfectant or cleanser compositions can be a one and two part aqueous composition, a non-aqueous liquid composition, a cast solid, a granular form, a particulate form, a compressed tablet, a gel and/or a paste and a slurry form. The transferases, e.g., transaminases, e.g., d-amino-acid transferases, and/or oxidoreductases, e.g., dehydrogenases, e.g., d-amino-acid dehydrogenases of the invention can also be used as a detergent, disinfectant or cleanser additive product in a solid or a liquid form. Such additive products are intended to supplement or boost the performance of conventional detergent compositions and can be added at any stage of the cleaning process.

The actual active enzyme content depends upon the method of manufacture of a detergent, disinfectant or cleanser composition and is not critical, assuming the detergent solution has the desired enzymatic activity. In one aspect, the amount of transferase, e.g., transaminase, e.g., d-amino-acid transferase, and/or oxidoreductase, e.g., dehydrogenase, e.g., d-amino-acid dehydrogenase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the transferases, e.g., transaminases, e.g., d-amino-acid transferases, and/or oxidoreductases, e.g., dehydrogenases, e.g., d-amino-acid dehydrogenases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Transferases, e.g., transaminases, e.g., d-amino-acid transferases, and/or oxidoreductases, e.g., dehydrogenases, e.g., d-amino-acid dehydrogenases of the invention can be formulated into powdered and liquid detergents, disinfectants or cleansers having pH between 4.0 and 12.0 at levels of about 0.01 to about 5% (preferably 0.1% to 0.5%) by weight. These detergent, disinfectant or cleanser compositions can also include other transferases, e.g., transaminases, e.g., d-amino-acid transferases, and/or oxidoreductases, e.g., dehydrogenases, e.g., d-amino-acid dehydrogenases and/or other enzymes such as xylanases, cellulases, lipases, esterases, proteases, or endoglycosidases, endo-beta.-1,4-glucanases, beta-glucanases, endo-beta-1,3(4)-glucanases, cutinases, peroxidases, catalases, laccases, amylases, glucoamylases, pectinases, oxidoreductases, reductases, oxidases, epimerases, isomerases, racemases, phenoloxidases, ligninases, pullulanases, arabinanases, hemicellulases, mannanases, xyloglucanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent, disinfectant or cleanser compositions can also include dyes, colorants, odorants, bleaches, buffers, builders, enzyme "enhancing agents" (see, e.g., U.S. Patent application no. 20030096394) and stabilizers.

In one aspect, the invention provides a method for cleaning or washing an object comprising contacting the object with a polypeptide of the invention under conditions sufficient for cleaning or washing. A transferase, e.g., transaminase, e.g., d-amino-acid transferase, and/or oxidoreductase, e.g., dehydrogenase, e.g., d-amino-acid dehydrogenase of the invention may be included as a detergent, disinfectant or cleanser additive. A fabric softener composition can comprise a transferase, e.g., transaminase, e.g., d-amino-acid transferase, and/or oxidoreductase, e.g., dehydrogenase, e.g., d-amino-acid dehydrogenase of the invention.

Treating Foods and Food Processing

The transferases, e.g., transaminases, e.g., d-amino-acid transferases, and/or oxidoreductases, e.g., dehydrogenases, e.g., d-amino-acid dehydrogenases of the invention have numerous applications in food processing industry. For example, in one aspect, the transferases, e.g., transaminases, e.g., d-amino-acid transferases, and/or oxidoreductases, e.g., dehydrogenases, e.g., d-amino-acid dehydrogenases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds. In another aspect, the transferases, e.g., transaminases, e.g., d-amino-acid transferases, and/or oxidoreductases, e.g., dehydrogenases, e.g., d-amino-acid dehydrogenases of the invention can be used for separation of components of plant cell materials.

The transferases, e.g., transaminases, e.g., d-amino-acid transferases, and/or oxidoreductases, e.g., dehydrogenases, e.g., d-amino-acid dehydrogenases of the invention can be used in the preparation of fruit or vegetable juices, syrups, extracts and the like to increase yield. The transferases, e.g., transaminases, e.g., d-amino-acid transferases, and/or oxidoreductases, e.g., dehydrogenases, e.g., d-amino-acid dehydrogenases of the invention can be used in the enzymatic treatment of various plant cell wall-derived materials or waste materials, e.g. from cereals, grains, wine or juice production, or agricultural residues such as vegetable hulls, bean hulls, sugar beet pulp, olive pulp, potato pulp, and the like. The transferases, e.g., transaminases, e.g., d-amino-acid transferases, and/or oxidoreductases, e.g., dehydrogenases, e.g., d-amino-acid dehydrogenases of the invention can be used to modify the consistency and appearance of processed fruit or vegetables. The transferases, e.g., transaminases, e.g., d-amino-acid transferases, and/or oxidoreductases, e.g., dehydrogenases, e.g., d-amino-acid dehydrogenases of the invention can be used to treat plant material to facilitate processing of plant material, including foods, facilitate purification or extraction of plant components.

In one aspect, transferases, e.g., transaminases, e.g., d-amino-acid transferases, and/or oxidoreductases, e.g., dehydrogenases, e.g., d-amino-acid dehydrogenases of the invention are used in baking applications, e.g., cookies, breads and crackers. In one aspect, transferases, e.g., transaminases, e.g., d-amino-acid transferases, and/or oxidoreductases, e.g., dehydrogenases, e.g., d-amino-acid dehydrogenases of the invention are used as additives in dough processing. In another aspect of the invention, the transferases, e.g., transaminases, e.g., d-amino-acid transferases, and/or oxidoreductases, e.g., dehydrogenases, e.g., d-amino-acid dehydrogenases of the invention can also be used in any food or beverage treatment or food or beverage production process. In another aspect of the invention, the transferases, e.g., transaminases, e.g., d-amino-acid transferases, and/or oxidoreductases, e.g., dehydrogenases, e.g., d-amino-acid dehydrogenases of the invention can be included in any food or beverage composition.

Feeds and Food or Feed or Food Additives

The invention provides methods for treating feeds, foods, food or feed additives, food or feed supplements, or dietary aids, using transferases, e.g., transaminases, e.g., d-amino-acid transferases, and/or oxidoreductases, e.g., dehydrogenases, e.g., d-amino-acid dehydrogenases of the invention, animals including mammals (e.g., humans), birds, fish and the like. The invention provides feeds, foods, food or feed additives, food or feed supplements, or dietary aids comprising transferases, e.g., transaminases, e.g., d-amino-acid transferases, and/or oxidoreductases, e.g., dehydrogenases, e.g., d-amino-acid dehydrogenases of the invention. In one aspect, treating feeds, foods, food or feed additives, food or feed supplements, or dietary aids using transferases, e.g., transaminases, e.g., d-amino-acid transferases, and/or oxidoreductases, e.g., dehydrogenases, e.g., d-amino-acid dehydrogenases of the invention can help in the availability of nutrients, e.g., starch, protein, sugars, and the like, in the feeds, foods, food or feed additives, food or feed supplements, or dietary aids.

The feeds, foods, food or feed additives, food or feed supplements, or dietary aids of the invention may be a granulated, pelletized or particulate form, which may be coated or uncoated. Alternatively, the feeds, foods, food or feed additives, food or feed supplements, or dietary aids of the invention may be a stabilized liquid composition. This may be an aqueous or oil-based slurry. See, e.g., U.S. Pat. No. 6,245,546.

In another aspect, transferases, e.g., transaminases, e.g., d-amino-acid transferases, and/or oxidoreductases, e.g., dehydrogenases, e.g., d-amino-acid dehydrogenases of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the transferase, e.g., transaminase, e.g., d-amino-acid transferase, and/or oxidoreductase, e.g., dehydrogenase, e.g., d-amino-acid dehydrogenase of the invention is produced in recoverable quantities. The transferases, e.g., transaminases, e.g., d-amino-acid transferases, and/or oxidoreductases, e.g., dehydrogenases, e.g., d-amino-acid dehydrogenases can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

A coating can be applied to the invention enzyme granules, pellets, particles for many different purposes, such as to add a flavor or nutrition supplement, to delay release nutrients and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise a transferase, e.g., transaminase, e.g., d-amino-acid transferase, and/or oxidoreductase, e.g., dehydrogenase, e.g., d-amino-acid dehydrogenase enzyme encoded by an amino acid sequence of the invention or at least 30 consecutive amino acids thereof. Preferably, the process includes compacting or compressing the particles of enzyme-releasing matrix into granules, which can be accomplished by pelletizing. The mold inhibitor and cohesiveness agent, when used, can be added at any suitable time, and can be mixed with the grain-based substrate in the desired proportions prior to pelletizing of the grain-based substrate. Moisture content in the pellet mill feed can be in the ranges set forth above with respect to the moisture content in the finished product, and can be about 14-15%. In one aspect, moisture is added to the feedstock in the form of an aqueous preparation of the enzyme to bring the feedstock to this moisture content. The temperature in the pellet mill can be brought to about 82° C. with steam. The pellet mill may be operated under any conditions that impart sufficient work to the feedstock to provide pellets. The pelleting process itself is a cost-effective process for removing water from the enzyme-containing composition.

In one aspect, the pellet mill is operated with a ⅛ in. by 2 inch die at 100 lb./min. pressure at 82° C. to provide pellets, which then are crumbled in a pellet mill crumbler to provide discrete plural particles having a particle size capable of passing through an 8 mesh screen but being retained on a 20 mesh screen.

The thermostable transferases, e.g., transaminases, e.g., d-amino-acid transferases, and/or oxidoreductases, e.g., dehydrogenases, e.g., d-amino-acid dehydrogenases of the invention can be used in the pellets of the invention. They can have high optimum temperatures and high heat resistance such that an enzyme reaction at a temperature not hitherto carried out can be achieved. The gene encoding the transferase, e.g., transaminase, e.g., d-amino-acid transferase, and/or oxidoreductase, e.g., dehydrogenase, e.g., d-amino-acid dehydrogenase according to the present invention (e.g. as set forth in any of the sequences in the invention) can be used in preparation of transferases, e.g., transaminases, e.g., d-amino-acid transferases, and/or oxidoreductases, e.g., dehydrogenases, e.g., d-amino-acid dehydrogenases (e.g. using GSSM as described herein) having characteristics different from those of the transferases, e.g., transaminases, e.g., d-amino-acid transferases, and/or oxidoreductases, e.g., dehydrogenases, e.g., d-amino-acid dehydrogenases of the invention (in terms of optimum pH, optimum temperature, heat resistance, stability to solvents, specific activity, affinity to substrate, secretion ability, translation rate, transcription control and the like).

Waste Treatment

The transferases, e.g., transaminases, e.g., d-amino-acid transferases, and/or oxidoreductases, e.g., dehydrogenases, e.g., d-amino-acid dehydrogenases of the invention can be used in a variety of other industrial applications, e.g., in waste treatment. For example, in one aspect, the invention provides a solid waste digestion process using transferase, e.g., transaminase, e.g., d-amino-acid transferase, and/or oxidoreductase, e.g., dehydrogenase, e.g., d-amino-acid dehydrogenase of the invention. The methods can comprise reducing the mass and volume of substantially untreated solid waste. Solid waste can be treated with an enzymatic digestive process in the presence of an enzymatic solution (including transferase, e.g., transaminase, e.g., d-amino-acid transferase, and/or oxidoreductase, e.g., dehydrogenase, e.g., d-amino-acid dehydrogenase of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In another aspect of the invention, the transferase, e.g., transaminase, e.g., d-amino-acid transferase, and/or oxidoreductase, e.g., dehydrogenase, e.g., d-amino-acid dehydrogenase of the invention can also be used in any waste treatment process. In another aspect of the invention, the transferase, e.g., transaminase, e.g., d-amino-acid transferase, and/or oxidoreductase, e.g., dehydrogenase, e.g., d-amino-acid dehydrogenase of the invention can be included in any waste treatment composition.

Oral Care Products

The invention provides oral care products comprising transf transferases, e.g., transaminases, e.g., d-amino-acid transferases, and/or oxidoreductases, e.g., dehydrogenases, e.g., d-amino-acid dehydrogenases of the invention, including the enzyme mixtures or "cocktails" of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

Biomass Conversion and Biofuel Production

The invention provides methods and processes for biomass conversion or any organic material to a fuel, e.g., to a fuel, e.g. a biofuel, such as bioethanol, biomethanol, biopropanol and/ or biobutanol and the like, using enzymes of the invention, including the enzyme mixtures or "cocktails" of the invention. Thus, the invention provides fuels, e.g., biofuels, such as bioethanols, comprising a polypeptide of the invention, including the enzyme mixtures or "cocktails" of the invention, or a polypeptide encoded by a nucleic acid of the invention. In alternative aspects, the fuel is derived from a plant material, which optionally comprises potatoes, soybean (rapeseed), barley, rye, corn, oats, wheat, beets or sugar cane, and optionally the fuel comprises a bioethanol or a gasoline-ethanol mix.

The invention provides methods for making a fuel comprising contacting a biomass composition or any organic material with a polypeptide of the invention, or a polypeptide encoded by a nucleic acid of the invention, or any one of the mixtures or "cocktails" or products of manufacture of the invention. In alternative embodiments, the biomass composition comprises a plant, plant product or plant derivative, and the plant or plant product can comprise cane sugar plants or plant products, beets or sugarbeets, wheat, corn, soybeans, potato, rice or barley. In one aspect, the fuel comprises a bioethanol or a gasoline-ethanol mix, or a biopropanol or a gasoline-propanol mix, or a biobutanol or a gasoline-butanol mix, or a biomethanol or a gasoline-methanol mix, or a biodiesel or a gasoline-biodiesel mix, or any combination thereof.

The invention provides methods for making bioethanol, biobutanol, biomethanol and/or a biopropanol comprising contacting a biomass composition or any organic material with a polypeptide of the invention, or a polypeptide encoded by a nucleic acid of the invention, or any one of the mixtures or "cocktails" or products of manufacture of the invention. In alternative embodiments, the biomass composition comprises a plant, plant product or plant derivative, and the plant or plant product can comprise cane sugar plants or plant products, beets or sugarbeets, wheat, corn, soybeans, potato, rice or barley. In alternative embodiments, the organic material or biomass is derived from an agricultural crop (e.g., wheat, barley, potatoes, switchgrass, poplar wood), is a byproduct of a food or a feed production, is a lignocellulosic waste product, or is a plant residue or a waste paper or waste paper product, and optionally the plant residue comprise stems, leaves, hulls, husks, corn or corn cobs, corn stover, corn fiber, hay, straw (e.g. rice straw or wheat straw), sugarcane bagasse, sugar beet pulp, citrus pulp, and citrus peels, wood, wood thinnings, wood chips, wood pulp, pulp waste, wood waste, wood shavings and sawdust, construction and/or demolition wastes and debris (e.g. wood, wood shavings and sawdust), and optionally the paper waste comprises discarded or used photocopy paper, computer printer paper, notebook paper, notepad paper, typewriter paper, newspapers, magazines, cardboard and paper-based packaging materials, and recycled paper materials. In addition, urban wastes, e.g. the paper fraction of municipal solid waste, municipal wood waste, and municipal green waste can be used.

The invention provides compositions (including products of manufacture, enzyme ensembles, or "cocktails") comprising a mixture (or "cocktail") of transferase, e.g., transaminase, e.g., d-amino-acid transferase, and/or oxidoreductase, e.g., dehydrogenase, e.g., d-amino-acid dehydrogenase enzymes.

The invention provides cells and/or organisms expressing enzymes of the invention (e.g., wherein the cells or organisms comprise as heterologous nucleic acids a sequence of this invention) for participation in chemical cycles involving natural biomass (e.g., plant) conversion. Alternatively, the polypeptide of the invention may be expressed in the biomass plant material or feedstock itself.

The methods of the invention also include taking the converted biomass (e.g., lignocellulosic) material (processed by enzymes of the invention) and making it into a fuel (e.g. a biofuel such as a bioethanol, biobutanol, biomethanol, a biopropanol, or a biodiesel) by fermentation and/or by chemical synthesis. In one aspect, the produced sugars are fermented and/or the non-fermentable products are gasified.

The methods of the invention also include converting algae, virgin vegetable oils, waste vegetable oils, animal fats and greases (e.g. tallow, lard, and yellow grease), or sewage, using enzymes of the invention, and making it into a fuel (e.g. a bioalcohol, e.g., a bioethanol, biomethanol, biobutanol or biopropanol, or biodiesel) by fermentation and/or by chemical synthesis or conversion.

The enzymes of the invention (including, for example, organisms, such as microorganisms, e.g., fungi, yeast or bacteria, and plants and plant cells and plant parts, e.g., seeds, making and in some aspects secreting recombinant enzymes of the invention) can be used in or included/integrated at any stage of any organic matter/biomass conversion process, e.g., at any one step, several steps, or included in all of the steps, or all of the following methods of biomass conversion processes, or all of these biofuel alternatives:

Direct combustion: the burning of material by direct heat and is the simplest biomass technology; can be very economical if a biomass source is nearby.

1 Pyrolysis: is the thermal degradation of biomass by heat in the absence of oxygen. In one aspect, biomass is heated to a temperature between about 800 and 1400 degrees Fahrenheit, but no oxygen is introduced to support combustion resulting in the creation of gas, fuel oil and charcoal.

2 Gasification: biomass can be used to produce methane through heating or anaerobic digestion. Syngas, a mixture of carbon monoxide and hydrogen, can be derived from biomass.

Landfill Gas: is generated by the decay (anaerobic digestion) of buried garbage in landfills. When the organic waste decomposes, it generates gas consisting of approximately 50% methane, the major component of natural gas.

Anaerobic digestion: converts organic matter to a mixture of methane, the major component of natural gas, and carbon dioxide. In one aspect, biomass such as waterwaste (sewage), manure, or food processing waste, is mixed with water and fed into a digester tank without air.

Fermentation

Alcohol Fermentation: fuel alcohol is produced by converting cellulosic mass and/or starch to sugar, fermenting the sugar to alcohol, then separating the alcohol water mixture by distillation. Feedstocks such as dedicated crops (e.g., wheat, barley, potatoes, switchgrass, poplar wood), agricultural residues and wastes (e.g. rice straw, corn stover, wheat straw, sugarcane bagasse, rice hulls, corn fiber, sugar beet pulp, citrus pulp, and citrus peels), forestry wastes (e.g. hardwood and softwood thinnings, hardwood and softwood residues from timber operations, wood shavings, and sawdust), urban wastes (e.g. paper fraction of municipal solid waste, municipal wood waste, municipal green waste), wood wastes (e.g. saw mill waste, pulp mill waste, construction waste, demolition waste, wood shavings, and sawdust), and waste paper or other materials containing sugar, starch, and/or cellulose can be converted to sugars and then to alcohol by fermentation with yeast. Alternatively, materials containing sugars can be converted directly to alcohol by fermentation.

Transesterification: An exemplary reaction for converting oil to biodiesel is called transesterification. The transesterification process reacts an alcohol (like methanol) with the triglyceride oils contained in vegetable oils, animal fats, or recycled greases, forming fatty acid alkyl esters (biodiesel) and glycerin. The reaction requires heat and a strong base catalyst, such as sodium hydroxide or potassium hydroxide.

Biodiesel: Biodiesel is a mixture of fatty acid alkyl esters made from vegetable oils, animal fats or recycled greases. Biodiesel can be used as a fuel for vehicles in its pure form, but it is usually used as a petroleum diesel additive to reduce levels of particulates, carbon monoxide, hydrocarbons and air toxics from diesel-powered vehicles.

Hydrolysis: includes hydrolysis of a compound, e.g., a biomass, such as a lignocellulosic material, catalyzed using an enzyme of the instant invention.

Cogeneration: is the simultaneous production of more than one form of energy using a single fuel and facility. In one aspect, biomass cogeneration has more potential growth than biomass generation alone because cogeneration produces both heat and electricity.

Enzymes of the invention can also be used in glycerin refining. The glycerin by-product contains unreacted catalyst and soaps that are neutralized with an acid. Water and alcohol are removed to produce 50% to 80% crude glycerin. The remaining contaminants include unreacted fats and oils, which can be processes using the polypeptides of the invention. In a large biodiesel plants of the invention, the glycerin can be further purified, e.g., to 99% or higher purity, for the pharmaceutical and cosmetic industries.

Biofuels as a Liquid or a Gas Gasoline

The invention provides biofuels and synthetic fuels in the form of a gas, or gasoline, e.g., a syngas. In one aspect, methods of the invention comprising use of enzymes of the invention for chemical cycles for natural biomass conversion, e.g., for the hydrolysis of a biomass to make a biofuel, e.g., a bioethanol, biopropanol, bio-butanol or a biomethanol, or a synthetic fuel, in the form of a liquid or as a gas, such as a "syngas".

For example, invention provides methods for making biofuel gases and synthetic gas fuels ("syngas") comprising a bioethanol, biopropanol, bio-butanol and/or a biomethanol made using a polypeptide of the invention, or made using a method of the invention; and in one aspect this biofuel gas of the invention is mixed with a natural gas (can also be produced from biomass), e.g., a hydrogen or a hydrocarbon-based gas fuel. In one aspect, the invention provides methods for processing biomass to a synthetic fuel, e.g., a syngas, such as a syngas produced from a biomass by gasification. In one aspect, the invention provides methods for making an ethanol, propanol, butanol and/or methanol gas from a sugar cane, e.g., a bagasse. In one aspect, this fuel, or gas, is used as motor fuel, e.g., an automotive, truck, airplane, boat, small engine, etc. fuel. In one aspect, the invention provides methods for making an ethanol, propanol, butanol and/or methanol from a plant, e.g., corn, or a plant product, e.g., hay or straw (e.g., a rice straw or a wheat straw, or any the dry stalk of any cereal plant), or an agricultural waste product.

In one aspect, the ethanol, propanol, butanol and/or methanol made using a method of composition of the invention can be used as a fuel (e.g., a gasoline) additive (e.g., an oxygenator) or in a direct use as a fuel. For example, a ethanol, propanol, butanol and/or methanol, including a fuel, made by a method of the invention can be mixed with ethyl tertiary butyl ether (ETBE), or an ETBE mixture such as ETBE containing 47% ethanol as a biofuel, or with MTBE (methyl tertiary-butyl ether). In another aspect, a ethanol, propanol, butanol and/or methanol, including a fuel, made by a method of the invention can be mixed with:

| IUPAC name | Common name |
|---|---|
| but-1-ene | α-butylene |
| cis-but-2-ene | cis-β-butylene |
| trans-but-2-ene | trans-β-butylene |
| 2-methylpropene | isobutylene |

A butanol and/or ethanol made by a method of the invention (e.g., using an enzyme of the invention) can be further processed using "A.B.E." (Acetone, Butanol, Ethanol) fermentation; in one aspect, butanol being the only liquid product. In one aspect, this butanol and/or ethanol is burned "straight" in existing gasoline engines (without modification to the engine or car), produces more energy and is less corrosive and less water soluble than ethanol, and can be distributed via existing infrastructures.

In one aspect, one, several or all of these alcohols are made by a process of the invention using an enzyme of the invention, and the process can further comprise a biomass-to-liquid technology, e.g., a gasification process to produce syngas followed by catalytic synthesis, or by a bioconversion of biomass to a mixed alcohol fuel.

The invention also provides processes comprising use of an enzyme of the invention incorporating (or, incorporated into) "gas to liquid", or GTL; or "coal to liquid", or CTL; or "biomass to liquid" or BTL; or "oilsands to liquid", or OTL, processes; and in one aspect these processes of the invention are used to make synthetic fuels. In one aspect, one of these processes of the invention comprises making a biofuel (e.g., a synfuel) out of a biomass using, e.g., the so-called "Fischer Tropsch" process (a catalyzed chemical reaction in which carbon monoxide and hydrogen are converted into liquid hydrocarbons of various forms; typical catalysts used are based on iron and cobalt; the principal purpose of this process is to produce a synthetic petroleum substitute for use as synthetic lubrication oil or as synthetic fuel). In one aspect, this synthetic biofuel of the invention can contain oxygen and can be used as additive in high quality diesel and petrol.

In alternative aspects, the processes of the invention use various pretreatments, which can be grouped into three categories: physical, chemical, and multiple (physical+chemical). Any chemicals can be used as a pretreatment agent, e.g., acids, alkalis, gases, cellulose solvents, alcohols, oxidizing agents and reducing agents. Among these chemicals, alkali is the most popular pretreatment agent because it is relatively inexpensive and results in less cellulose degradation. The common alkalis sodium hydroxide and lime also can be used as pretreatment agents. Although sodium hydroxide increases biomass digestibility significantly, it is difficult to recycle, is relatively expensive, and is dangerous to handle. In contrast, lime has many advantages: it is safe and very inexpensive, and can be recovered by carbonating wash water with carbon dioxide.

In one aspect, the invention provides a biofuel, e.g., a biogas, produced by the process of anaerobic digestion of organic material by anaerobes, wherein the process comprises use of an enzyme of the invention or a method of the invention. This biofuel, e.g., a biogas, can be produced either from biodegradable waste materials or by the use of energy crops fed into anaerobic digesters to supplement gas yields. The solid output, digestate, can also be used as a biofuel.

The invention provides methods for making biologically produced oils, including crude oils, and gases that can be used in diesel engines, wherein the process comprises use of an enzyme of the invention or a method of the invention. In one aspect, these methods can refine petroleum, e.g., crude oils, into kerosene, petroleum, diesel and other fractions.

The invention provides methods (using an enzyme of the invention or a method of the invention) for making biologically produced oils from:

Straight vegetable oil (SVO).
Waste vegetable oil (WVO)—waste cooking oils and greases produced in quantity mostly by commercial kitchens.
Biodiesel obtained from transesterification of animal fats and vegetable oil, directly usable in petroleum diesel engines.
Biologically derived crude oil, together with biogas and carbon solids via the thermal depolymerization of complex organic materials including non oil based materials; for example, waste products such as old tires, offal, wood and plastic.
Pyrolysis oil; which may be produced out of biomass, wood waste etc. using heat only in the flash pyrolysis process (the oil may have to be treated before using in conventional fuel systems or internal combustion engines).
Wood, charcoal, and dried dung.

The invention will be further described with reference to the following examples; however, it is to be understood that the invention is not limited to such examples.

EXAMPLES

The aminotransferases and oxidoreductases described herein were obtained using a selection strategy. In this selection strategy, environmental DNA libraries were constructed in a bacterial host strain that exhibits L-tryptophan auxotrophy. Library clones were innoculated onto media containing D-tryptophan (but lacking L-tryptophan). The only clones that could grow are those that expressed a gene on one of the discrete environmental DNA fragments that encoded an enzyme active on D-tryptophan. For example, clones were identified that expressed an active tryptophan racemase and were able to convert D-tryptophan to L-tryptophan. Additionally, clones were identified that expressed an oxidoreductase (such as an amino acid oxidase or a dehydrogenase) that could convert D-tryptophan to an intermediate that the host cell could, in turn, convert to L-tryptophan. In the case of oxidoreductases such as aminoacid oxidases and dehydrogenases, one such intermediate is indole-3-pyruvate.

The Examples in Part A describe the methodologies used for initial characterization of the candidate DAT and oxidoreductase nucleic acids and the encoded polypeptides. Further characterization of particular nucleic acids and polypeptides is described in Part B.

Part A

Example 1

Growth and Assay Procedures #1

Enzyme Preparation

Glycerol stocks were used to inoculate flasks containing 50 mL of LB medium with the appropriate antibiotic. The starter cultures were grown overnight at 37° C. with shaking at 230 rpm and the $OD_{600nm}$ was checked. The starter culture was used to inoculate 400 mL to $OD_{600nm}$ of 0.05. The culture was incubated at 37° C. with shaking at 230 rpm.

Cultures were induced with 1 mM IPTG when the $OD_{600nm}$ was between 0.5 and 0.8 and incubated at 30° C. and 230 rpm overnight. Cultures were harvested by pelleting cells by centrifugation at 4000 rpm for 15 minutes. The supernatant was poured off and the pellet was either frozen for later use or resuspended in 20 mL of 50 mM sodium phosphate buffer (pH 7.5) supplemented with 26 U/mL of DNAse and lysed using a microfluidizer (Microfluidics Corporation, Newton, Mass.) per the manufacturer's instructions. The clarified lysate was collected and centrifuged at 11,000 rpm for 30 minutes. The supernatant was collected in a clean tube and filtered through a 0.2 µm filter. Five mL aliquots of the clarified lysate were placed in a vial and freeze-dried using a lyophilizer (Virtis Company, Gardinier, N.Y.) per the manufacturer's instructions. Approximately 1 mL of the clarified lysate was retained for protein quantitation using the Bio-Rad Protein Assay Reagent (Bio-Rad, Hercules, Calif.) and SDS-PAGE analysis. Then, the amount of protein in each lyophilized sample was calculated.

Activity Assay

Enzymes for activity assays were prepared in 50 mM sodium phosphate pH 7.5. DAT assays were usually performed using approximately 1 mg/mL total protein.

DAT Assay Using RR-Monatin Substrate

Twenty-five mM RR-monatin, 25 mM pyruvic acid sodium salt, 0.08 mM PLP, 90 mM sodium phosphate pH 8.0 and 0.8 mg/mL DAT (total protein) prepared as described above (under 'Enzyme Preparation' section) were combined and incubated at 30° C. at 300 rpm. At various timepoints (generally 0, 2, 4, and 24 hours), 50 µL of the reaction product was transferred to 150 µL of ice cold acetonitrile, and the sample vortexed for 30 seconds. Samples were centrifuged at 13,200 rpm for 10 minutes at 4° C., and the supernatant was passed through a 0.45 µm filter. The filtrate was diluted 10-fold in methanol, and samples were analyzed by Liquid Chromatography/Mass Spectrometry/Mass Spectrometry (LC-MS/MS) to monitor the D-alanine formed (described in this Example below under 'LC/MS/MS method for detecting D-alanine or R,R-monatin' section).

DAT Assay Using Tryptophan Substrate

Ten mM D-tryptophan, 25 mM pyruvic acid sodium salt, 0.08 mM PLP, 90 mM sodium phosphate pH 8.0, and 0.8 mg/mL DAT (total protein) prepared as described above (under 'Enzyme Preparation' section) were combined and incubated at 30° C. and 300 rpm. At timepoints (generally 0, 2, 4, and 24 hours), 50 µL of the reaction product was transferred to 150 µL of ice cold acetonitrile, vortexed for 30 seconds, and centrifuged at 13,200 rpm for 10 minutes at 4° C. The supernatant was passed through a 0.45 µm filter and the filtrate was diluted 10-fold in methanol. Samples were analyzed by LC/MS/MS to monitor the D-alanine formed (described in this Example below under 'LC/MS/MS method for detecting D-alanine or R,R-monatin' section).

LC/MS/MS Method for Detecting D-Alanine or R,R-Monatin

Liquid Chromatography/Mass Spectrometry/Mass Spectrometry (LC-MS/MS) screening was achieved by injecting samples from 96-well plates using a CTCPal auto-sampler (LEAP Technologies, Carrboro, N.C.) into a 30/70H$_2$O/Acn (0.1% formic acid) mixture provided by LC-10ADvp pumps (Shimadzu, Kyoto, Japan) at 1.0 mL/min through a Zorbax ECLIPSE XDB-C8™ (2.1×50 mm) column and into the API4000 TURBOION-SPRAY™ triple-quad mass spectrometer (Applied Biosystems, Foster City, Calif.).

Ion spray and Multiple Reaction Monitoring (MRM) were performed for the analytes of interest in the positive ion mode. alanine: parent/daughter ions: 90.12/44.25 monatin: parent/daughter ions: 293.11/130.15.

Example 2

Activity of DATs Using Assay Procedures #1

The vector pSE420-cHis is a derivative of pSE420 (Invitrogen, Carlsbad, Calif.). For pSE420-cHis, the vector was cut with NcoI and Hind III, and ligated with C-His. C-His: 5'-CCA TGG GAG GAT CCA GAT CTC ATC ACC ATC ACC ATC ACT AAG CTT (SEQ ID NO:977). The expression of the His-tag in this vector depends on the choice of host and stop codon. That is, if a TAG stop codon and a supE host are used, the His-tag is expressed; if a TAG stop codon and a non supE host are used, the His-tag is not expressed. Unless indicated otherwise, the His-tag was not expressed in these experiments.

The DAT subclones were in the pSE420-cHis vector/*E. coli* HMS174 host (Novagen, San Diego, Calif.) with the exception of the following subclones: SEQ ID NO:930, 932, 936 were in the pET101 D-Topo vector/BL21Star(DE3) host (Invitrogen, Carlsbad, Calif.); SEQ ID NO:934 was in the pET101 D-Topo vector/BL21 CODON PLUSRIL™ host (Stratagene, La Jolla, Calif.); SEQ ID NO:938, 942, 944, 946 were in the pSE420 vector/XL1BLUE™ host (Stratagene, La Jolla, Calif.); SEQ ID NO:940, 948, 950, 962 and 966 were in the pSE420-c-His vector/XL1BLUE™ host (Stratagene, La Jolla, Calif.); and SEQ ID NO:928 was in the pQET1 vector/M15pREP4 host (pQET1 described in U.S. Pat. Nos. 5,814,473 and 6,074,860; M15pREP4 from Qiagen; Valencia, Calif.).

The subclones were grown, lysed and lyophilized according to the procedures described in Example 1. Samples were tested for activity on R,R-monatin as well as D-tryptophan (as described in Example 1). For the monatin DAT assay, DATs were incubated with 25 mM R,R-monatin, 25 mM pyruvic acid sodium salt, and 0.08 mM PLP (pH 8) at 30° C. For the D-tryptophan DAT assay, DATs were incubated with 10 mM D-tryptophan, 25 mM pyruvic acid sodium salt, and 0.08 mM PLP (pH 8) at 30° C. All DATs were loaded at 0.8 mg/mL total protein in both assays.

At indicated timepoints, 50 µL of the reaction product was added to 150 µl, of ice-cold acetonitrile. Samples were vortexed for 30 seconds and the supernatant was then diluted ten-fold in methanol. Samples were then analyzed by LC/MS/MS (as described in Example 1) to monitor the D-alanine formed. The tables below show the D-aminotransferase activity on both substrates.

TABLE 4

Activity of D-aminotransferase subclones on R,R-monatin and D-tryptophan

| SEQ ID NO: | Activity on R,R-monatin µg/mL D-alanine formed at indicated hour | Activity on D-tryptophan µg/mL D-alanine formed at indicated hour | Relative Expression |
|---|---|---|---|
| 928 | 30@24 hr | NT | + |
| 938 | 122@24 hr | NT | ++ |
| 940 | 5@24 hr | NT | ND |
| 942 | 12@24 hr | NT | ND |
| 944 | 75@24 hr | NT | ND |
| 946 | 39@24 hr | NT | ND |
| 948 | 200@0.5 hr | 441@0.5 hr | ND |
| 950 | 75@0.5 hr | 452@0.5 hr | ND |
| 962 | NT | NT | + |
| 964 | 7@24 hr | ND@24 hr | ++ |
| 966 | NT | NT | ++ |
| 968 | 6.7@24 hr | 52@24 hr | +++ |
| 886 (expressed in XL1Blue cells) | NT | NT | ++ |

NT, not tested;
ND, not detected under conditions used;
+, low expression,
++, moderate expression,
+++, high expression

| SEQ ID NO: | Activity on R,R-monatin µg/mL D-alanine formed at indicated hour | Activity on D-tryptophan µg/mL D-alanine formed at indicated hour | Relative Expression |
|---|---|---|---|
| 886 (expressed in *E. coli* HMS174 cells) | 15.4@24 hr | 143@24 hr | +++ |
| 888 (expressed in XL1 Blue cells) | NT | NT | ++ |
| 888 (expressed in HMS174 cells) | 7@24 hr | 317@24 hr | +++ |

TABLE 4-continued

Activity of D-aminotransferase subclones on R,R-monatin and D-tryptophan

| | | | |
|---|---|---|---|
| 890 (expressed in XL1 Blue cells) | NT | NT | ++ |
| 890 (expressed in HMS174 cells) | 54@24 hr | 278@24 hr | +++ |
| 892 (expressed in XL1 Blue cells) | NT | NT | + |
| 892 (expressed in HMS174 cells) | 113@24 hr | <5@24 hr | ++ |
| 894 (expressed in XL1 Blue cells) | NT | NT | ND |
| 894 (expressed in HMS174 cells) | 16@24 hr | 116@24 hr | + |
| 866 | 28@24 hr | NT | +++ |
| 868 | <1@24 hr | NT | +++ |
| 970 | 10.8@24 hr | NT | + |
| 870 | 123.5@24 hr | NT | +++ |
| 872 | 62.3@24 hr | NT | +++ |
| 874 | 46.5@24 hr | NT | +++ |
| 876 | 44@24 hr | NT | ++ |
| 878 | 37@24 hr | NT | +++ |
| 972 | <5@24 hr | NT | + |
| 880 | 72.4@24 hr | 79.6@24 hr | + |
| 882 | 158.8@24 hr | 344@2 hr | +++ |
| 884 | 290@24 hr | 363@2 hr | ++ |
| 896 | 54@24 hr | 450@2 hr | +++ |
| 898 | 466@24 hr | 300@24 hr | + |
| 900 | 135@24 hr | 154@24 hr | + |
| 902 | 280@24 hr | 130@24 hr | ++ |
| 904 | 170@24 hr | 140@24 hr | + |
| 906 | 700@24 hr | 500@24 hr | +++ |
| 908 | 55@24 hr | 45@24 hr | + insoluble |

NT, not tested;
ND, not detected;
+, low expression;
++, moderate expression;
+++, high expression

| SEQ ID NO: | Activity on R,R-monatin µg/mL D-alanine formed at indicated hour | Activity on D-tryptophan µg/mL D-alanine formed at indicated hour | Relative Expression |
|---|---|---|---|
| 910 | 384@24 hr | 240@24 hr | +++ |
| 912 | NT | NT | ND |
| 914 | NT | NT | ND |
| 916 | NT | NT | ND |
| 918 | NT | NT | ND |
| 920 | NT | NT | ND |
| 922 | NT | NT | ND |
| 924 | NT | NT | ND |
| 926 | NT | NT | ND |
| 974 (expressed in HMS174 cells) | NT | NT | ND |
| 974 (expressed in XL1 Blue cells) | NT | NT | ND |
| 930 | NT | NT | ND |
| 932 | NT | NT | ND |
| 934 | NT | NT | ND |
| 936 | NT | NT | ND |
| 976 (expressed in LX1 Blue cells) | NT | <5@24 hr | ++ |

NT, not tested;
ND, not detected;
+, low expression;
++, moderate expression;
+++, high expression It should be noted that there are only very conservative differences between the subclones listed above and their native sequences that are also in the sequence listing. For example, quite often, a start or stop codon was modified to be more efficient for expression in *E. coli*. It is expected that cloning of the wildtype sequences would give similar results in terms of DAT activity.

Part B

Example 3

Detection of Monatin, MP, Tryptophan, Alanine, and HMG

This example describes the analytical methodology associated with the further characterization of selected D-aminotransferase (DAT) enzymes.

LC/MS/MS Multiple Reaction Monitoring (MRM) Analysis of Monatin and Tryptophan

Analyses of mixtures for monatin and tryptophan derived from biochemical reactions were performed using a Waters/ MICROMASS® liquid chromatography-tandem mass spectrometry (LC/MS/MS) instrument including a Waters 2795™ liquid chromatograph with a Waters 996 Photo-Diode Array (PDA) absorbance monitor placed in series between the chromatograph and a MICROMASS® QUATTRO ULTIMA® triple quadrupole mass spectrometer. LC separations were made using an Xterra MS C8 reversed-phase chromatography column, 2.1 mm×250 mm at 40° C. The LC mobile phase consisted of A) water containing 0.3% formic acid and 10 mM ammonium formate and B) methanol containing 0.3% formic acid and 10 mM ammonium formate.

The gradient elution was linear from 5% B to 45% B, 0-8.5 min, linear from 45% B to 90% B, 8.5-9 min, isocratic from 90% B to 90% B, 9-12.5 min, linear from 90% B to 5% B, 12.5-13 min, with a 4 min re-equilibration period between runs. The flow rate was 0.27 mL/min, and PDA absorbance was monitored from 210 nm to 400 nm. All parameters of the ESI-MS were optimized and selected based on generation of protonated molecular ions ([M+H]+) of the analytes of interest, and production of characteristic fragment ions. The following instrumental parameters were used for LC/MS/MS Multiple Reaction Monitoring (MRM) analysis of monatin and tryptophan: Capillary: 3.5 kV; Cone: 40 V; Hex 1: 20 V; Aperture: 0 V; Hex 2: 0 V; Source temperature: 100° C.; Desolvation temperature: 350° C.; Desolvation gas: 500 L/h; Cone gas: 50 L/h; Low mass resolution (Q1): 12.0; High mass resolution (Q1): 12.0; Ion energy: 0.2; Entrance: −5 V; Collision Energy: 8; Exit: 1 V; Low mass resolution (Q2): 15; High mass resolution (Q2): 15; Ion energy (Q2): 3.5; Multiplier: 650. Four monatin-specific parent-to-daughter MRM transitions and one tryptophan specific parent-to-daughter transition are used to specifically detect monatin and tryptophan in in vitro and in vivo reactions. The transitions monitored are 293.08 to 157.94, 293.08 to 167.94, 293.08 to 130.01, and 293.08 to 256.77. Tryptophan is monitored with the MRM transition 205.0 to 146.0. For internal standard quantification of monatin and tryptophan, four calibration standards containing four different ratios of each analyte to $d_5$-tryptophan and $d_5$-monatin, are analyzed. These data are subjected to a linear least squares analysis to form a calibration curve for monatin and tryptophan. To each sample is added a fixed amount of $d_5$-tryptophan and $d_5$-monatin ($d_5$-monatin was synthesized from $d_5$-tryptophan according to the methods from WO 2003/091396 A2), and the response ratios (monatin/$d_5$-monatin; tryptophan/$d_5$-tryptophan) in conjunction with the calibration curves described above are used to calculate the amount of each analyte in the mixtures. Parent-to-daughter mass transitions monitored for $d_5$-tryptophan and $d_5$-monatin are 210.0 to 150.0, and 298.1 to 172.0 and 298.1 to 162.00 respectively.

Chiral LC/MS/MS (MRM) Measurement of Monatin

Determination of the stereoisomer distribution of monatin in biochemical reactions was accomplished by derivatization with 1-fluoro-2-4-dinitrophenyl-5-L-alanine amide (FDAA), followed by reversed-phase LC/MS/MS MRM measurement.

Derivatization of Monatin with FDAA

To 50 µL of sample or standard and 10 µL of internal standard was added 100 µL of a 1% solution of FDAA in acetone. Twenty 4, of 1.0 M sodium bicarbonate was added, and the mixture was incubated for 1 h at 40° C. with occasional mixing. The sample was removed and cooled, and neutralized with 20 µL of 2.0 M HCl (more HCl may be required to effect neutralization of a buffered biological mixture). After degassing was complete, samples were ready for analysis by LC/MS/MS.

LC/MS/MS Multiple Reaction Monitoring for the Determination of the Stereoisomer Distribution of Monatin Analyses were performed using the LC/MS/MS instrumentation described in the previous sections. The LC separations capable of separating all four stereoisomers of monatin (specifically FDAA-monatin) were performed on a Phenomenex Luna® 2.0×250 mm (3 µm) C18 reversed phase chromatography column at 40° C. The LC mobile phase consisted of A) water containing 0.05% (mass/volume) ammonium acetate and B) acetonitrile. The elution was isocratic at 13% B, 0-2 min, linear from 13% B to 30% B, 2-15 min, linear from 30% B to 80% B, 15-16 min, isocratic at 80% B 16-21 min, and linear from 80% B to 13% B, 21-22 min, with a 8 min re-equilibration period between runs. The flow rate was 0.23 mL/min, and PDA absorbance was monitored from 200 nm to 400 nm. All parameters of the ESI-MS were optimized and selected based on generation of deprotonated molecular ions ([M−H]−) of FDAA-monatin, and production of characteristic fragment ions.

The following instrumental parameters were used for LC/MS analysis of monatin in the negative ion ESI/MS mode: Capillary: 3.0 kV; Cone: 40 V; Hex 1: 15 V; Aperture: 0.1 V; Hex 2: 0.1 V; Source temperature: 120° C.; Desolvation temperature: 350° C.; Desolvation gas: 662 L/h; Cone gas: 42 L/h; Low mass resolution (Q1): 14.0; High mass resolution (Q1): 15.0; Ion energy: 0.5; Entrance: 0 V; Collision Energy: 20; Exit: 0 V; Low mass resolution (Q2): 15; High mass resolution (Q2): 14; Ion energy (Q2): 2.0; Multiplier: 650. Three FDAA-monatin-specific parent-to-daughter transitions were used to specifically detect FDAA-monatin in in vitro and in vivo reactions. The transitions monitored for monatin were 542.97 to 267.94, 542.97 to 499.07, and 542.97 to 525.04. Monatin internal standard derivative mass transition monitored was 548.2 to 530.2. Identification of FDAA-monatin stereoisomers was based on chromatographic retention time as compared to purified monatin stereoisomers, and mass spectral data. An internal standard was used to monitor the progress of the reaction and for confirmation of retention time of the S,S stereoisomer.

Liquid Chromatography-Post Column Fluorescence Detection of Amino Acids, Including Tryptophan, Monatin, Alanine, and HMG Procedure for Trytophan, Monatin, and Alanine Liquid chromatography with post-column fluorescence detection for the determination of amino acids in biochemical reactions was performed on a Waters 2690 LC system or equivalent combined with a Waters 474 scanning fluorescence detector, and a Waters post-column reaction module (LC/OPA method). The LC separations were performed on an Interaction-Sodium loaded ion exchange column at 60° C. Mobile phase A was Pickering Na 328 buffer (Pickering Laboratories, Inc.; Mountain View, Calif.). Mobile phase B was Pickering Na 740 buffer. The gradient elution was from 0% B to 100% B, 0-20 min, isocratic at 100% B, 20-30 min, and linear from 100% B to 0% B, 30-31 min, with a 20 min re-equilibration period between runs. The flow rate for the mobile phase was 0.5 mL/min. The flow rate for the OPA post-column derivatization solution was 0.5 mL/min. The fluorescence detector settings were EX 338 nm and Em 425 nm. Norleucine was employed as an internal standard for the analysis. Identification of amino acids was based on chromatographic retention time data for purified standards.

Procedure for HMG

Samples from biochemical reactions were cleaned up by solid phase extraction (SPE) cartridges containing C18 as the packing material and 0.6% acetic acid as the eluent. The collected fraction from SPE was then brought up to a known volume and analyzed using HPLC post-column O-Phthaladehyde (OPA) derivatization with a florescensce detector. Chromatographic separation was made possible using a Waters 2695 liquid chromatography system and two Phenomenex AquaC 18 columns in series; a 2.1 mm×250 mm column with 5 µm particles, and a 2.1 mm×150 mm column with 3 particles. The temperature of the column was 40° C. and the column isocratic flow rate was 0.18 mL/min. The mobile phase was 0.6% acetic acid. OPA post-column derivatization and detection system consists of a Waters Reagent Manager (RMA), a reaction coil chamber, a temperature control module for the reaction coil chamber, and a Waters 2847 Florescent detector. The OPA flow rate was set at 0.16 mL/min, and the reaction coil chamber was set to 80° C. The florescensce detector was set with an excitation wavelength of 348 nm and an emission wavelength of 450 nm. Other parameters controlling detector sensitivity, such as signal gain and attenuation, were set to experimental needs. Quantification of HMG was based off of the molar response of glutamic acid.

Detection of MP by LC/MS

Liquid chromatography separations were made using Waters 2690 liquid chromatography system and a 2.1 mm×50 mm Agilent Eclipse XDB-C18 1.8 µm reversed-phase chromatography column with flow rate at 0.25 mL/min and gradient conditions as follows:

| Time (min) | A % | B % |
|---|---|---|
| 0.00 | 95 | 5 |
| 0.2 | 95 | 5 |
| 1.2 | 5 | 95 |
| 4.5 | 5 | 95 |
| 5.0 | 95 | 5 |
| 10 | 95 | 5 |

The mobile phase A was 0.3% (v/v) formic acid with 10 mM ammonium formate, and mobile phase B was 0.3% formic acid w/10 mM ammonium formate in 50:50 methanol/acetonitrile. The column temperature was 40° C.

Parameters for the Micromass ZQ quadrupole mass spectrometer operating in negative electrospray ionization mode (−ESI) were set as follows: Capillary: 2.2 kV; Cone: 35 V; Extractor: 4 V; RF lens: 1 V; Source temperature: 120° C.; Desolvation temperature: 380° C.; Desolvation gas: 600 L/h; Cone gas: Off; Low mass resolution: 15.0; High mass resolution: 15.0; Ion energy: 0.2; Multiplier: 650. Single ion monitoring MS experiment was set up to allow detection selectively for m/z 290.3, 210.3, 184.3, and 208.4. The m/z 208.4 is the deprotonated molecular $[M-H]^-$ ion of the internal standard $d_5$-tryptophan.

Detection of MP by LC/MS/MS

LC separations were made using Waters HPLC liquid chromatography system and a 2.1 mm×50 mm Agilent Eclipse XDB-C18 1.8 µm reversed-phase chromatography column with flow rate at 0.25 mL/min and gradient conditions are as follows:

| Time (min) | A % | B % |
|---|---|---|
| 0.00 | 95 | 5 |
| 0.7 | 95 | 5 |
| 3.0 | 5 | 95 |
| 4.0 | 5 | 95 |
| 4.3 | 95 | 5 |
| 6.0 | 95 | 5 |

Mobile phase A was 0.3% (v/v) formic acid with 10 mM ammonium formate, and B was 0.3% formic acid with 10 mM ammonium formate in 50:50 methanol/acetonitrile. The column temperature was 40° C.

Parameters on Waters Premier XE triple quadrupole mass spectrometer for LC/MS/MS Multiple Reaction Monitoring (MRM) experiments operating in negative electrospray ionization mode (−ESI) were set as the following; Capillary: 3.0 kV; Cone: V; Extractor: 3 V; RF lens: 0 V; Source temperature: 120° C.; Desolvation temperature: 350° C.; Desolvation gas: 650 L/hr; Cone gas: 47 L/hr; Low mass resolution (Q1): 13.5; High mass resolution (Q1): 13.5; Ion energy (Q1): 0.5 V; Entrance: 1 V; Collision Energy: 18 V; Exit 1: 19; Low mass resolution (Q2): 15; High mass resolution (Q2): 15; Ion Energy (Q2): 2.0; Multiplier: 650. Four parent-to-daughter MRM transitions were monitored to selectively detect Monatin precursor (MP) and $d_5$-Monatin precursor ($d_5$-MP); $d_5$-MP was used as an internal standard (I.S.). The four MRM transitions were 290.1 to 184.1, 290.1 to 210.1, 290.1 to 228.1, and 295.1 to 189.1. Two of these transitions, 290.1 to 184.1 for MP, and 295.1 to 189.1 for $d_5$-MP, were used for generating calibration curves and for quantification purposes. Transitions of 290.1 to 210.1 and 290.1 to 228.1 were used as qualitative secondary confirmation of MP.

Production of Monatin and MP for Standards and for Assays

Production of Monatin

A racemic mixture of R,R and S,S monatin was synthetically produced as described in U.S. Pat. No. 5,128,482. The R,R and S,S monatin were separated by a derivatization and a hydrolysis step. Briefly, the monatin racemic mixture was esterified, the free amino group was blocked with carbamazepine (CBZ), a lactone was formed, and the S,S lactone was selectively hydrolyzed using an immobilized protease enzyme. The monatin can also be separated as described in Bassoli et al., *Eur. J. Org. Chem.*, 8:1652-1658, (2005).

MP Production

R-MP was produced by the transamination of R,R monatin using AT-103 broad range D-aminotransferase (BioCatalytics, Pasadena, Calif.) in 0.1 M potassium phosphate buffer, using sodium pyruvate as the amino acceptor. S-MP was produced by the transamination of S,S monatin using AT-102 L-aminotransferase (BioCatalytics) in 0.1 M potassium phosphate buffer, using sodium pyruvate as the amino acceptor. Both reactions were carried out at 30° C. and at a pH of approximately 8.0-8.3, for approximately 20 hours. Both compounds were purified using preparative scale HPLC with a Rohm and Haas (Philadelphia, Pa.) hydrophobic resin (XAD™ 1600), eluting in water. Samples containing greater than 90% purity monatin precursor were collected and freeze-dried.

Example 4

Protein Preparation Methods

This example describes the methodology used for cloning, expression, cell extract preparation, protein purification, and protein quantification for secondary characterization of selected DATs.

Those of skill in the art would realize that the presence of activity in a polypeptide encoded from a subcloned (e.g., a fragment) or otherwise modified (e.g., tagged) nucleic acid is considered predictive of the presence of activity in the corresponding polypeptide encoded from the full-length or wild type nucleic acid.

Amplification of DAT-Encoding Genes for Cloning into Topo Plasmids

PCR reactions for Topo cloning (using either Pfu Turbo or Cloned Pfu from Stratagene) were as follows: 1× recommended buffer for the polymerase enzyme, 0.2 mM dNTPs, 0.5 μM of each primer, and 1 μl per 50 μl of reaction of the polymerase (2.5 units). The reactions contained approximately 5-100 ng of template DNA per reaction. A 94° C. hot start for 2 minutes was used for PCRs, as well as a melting temperature of 94° C. The annealing temperature was dependent on the Tm of the primers, and was either 30 or 60 seconds. The extension time (at 72° C.) was at least 2 min per kb. The reaction products were normally separated on a 1×TAE 1% agarose gel, and bands of appropriate sizes were purified with QIAquick Gel Extraction Kit as recommend by the manufacturer except an elution volume of 10 to 50 μl was used. Volumes of 1 to 4 μl of the purified PCR product were used for ligation with the pCRII-Topo Blunt plasmid (Invitrogen, Carlsbad, Calif.) as recommended by the manufacturer.

Cloning of DATs in pET30a for Untagged Expression

The DATs having the sequence shown in SEQ ID NO:945, 947, 949, 891, 893, 869, 873, 877, 881, 883, and 895 (encoding the polypeptides having the sequence of SEQ ID NO:946, 948, 950, 892, 894, 870, 874, 878, 882, 884, and 896) were amplified from plasmids or PCR products with Pfu Turbo (Stratagene, La Jolla, Calif.) and primers adding a Nde I at the 5' end and either a Not I or BamH I restriction site at the 3' end. The PCR fragments were cloned into pCR-Blunt II-Topo (Invitrogen, Carlsbad, Calif.) as recommended by the manufacturer. The sequence was verified by sequencing (Agencourt, Beverly, Mass.) and inserts with the correct sequences were then released from the vector using the appropriate restriction enzymes and ligated into the Nde I and Not I (or BamH I) restriction sites of pET30a. See Table 5 for specific primers.

The DAT nucleic acid having the sequence of SEQ ID NO:155 (encoding the polypeptide having SEQ ID NO:156) was amplified with Pfu Turbo (Stratagene) and primers adding a Nde I and Hind III restriction site at the 5' and 3' end, respectively. The PCR fragments were digested using Nde I and Hind III restriction enzymes and ligated into the Nde I and Hind III restriction sites of pET30a. See Table 5 for specific primers. It should be noted that the polypeptide having the sequence of SEQ ID NO:156 appeared to contain the following leader sequence with a probability of 0.991 (as determined by SignalP, as discussed in Nielsen, 1997, *Protein Engineering*, 10:1-6): KNSPIIAAYRAATPGSAAA (SEQ ID NO:1084). The nucleic acid encoding this DAT polypeptide was cloned with the apparent leader sequence.

TABLE 5

Primers for amplification

| Amplifies SEQ ID NO: | PCR primers | SEQ ID NO: |
|---|---|---|
| 945 | 5'-CCGCCCCATATGAACGCACTAGGATATTACAACGGAAAATGG-3' | 978 |
|  | 5'-GGCGGATCCTTATCCAAAGAATTCGGCACGAGCTGTC-3' | 979 |
| 947 | 5'-CCGCCCCATATGCGCGAAATTGTTTTTTTGAATGGG-3' | 980 |
|  | 5'-CGGATCCCTAAACCATCTCAAAAAACTTTTGCTGAATAAACCGTG-3' | 981 |
| 949 | 5'-CCGCCCCATATGTTGGATGAACGGATGGTGTTCATTAAC-3' | 982 |
|  | 5'-GGCGGATCCCTAGTCCACGGCATAGAGCCACTCGG-3' | 983 |
| 891 | 5'-GGCCGCATATGGACGCACTGGGATATTACAACGGAAAATG-3' | 984 |
|  | 5'-GGCCGCGGCCGCCTATGCCTTTCTCCACTCAGGCGTGTAGC-3' | 985 |
| 893 | 5'-GGCCGCATATGGACGCACTGGGATATTACAACGGAAAATG-3' | 986 |
|  | 5'-GGCCGCGGCCGCCTATACTGTGCTCCACTCAGGCGTGTAGCC-3' | 987 |
| 869 | 5'-CATATGTATTCATTATGGAATGATCAAATAGTGAAGG-3' | 988 |
|  | 5'-GCGGCCGCCTATTTATTCGTAAAAGGTGTTGGAATTTTCG-3' | 989 |
| 873 | 5'-CATATGAGCACCCCGCCGACCAATC-3' | 990 |
|  | 5'-GCGGCCGCCTAGGCCGCCTTCACTTCACGCTC-3' | 991 |
| 877 | 5'-CATATGAGCACCCCGCCAACCAATTC-3' | 992 |
|  | 5'-GCGGCCGCCTACGCGGCCTTCACTTCGCGC-3' | 993 |

TABLE 5-continued

Primers for amplification

| Amplifies SEQ ID NO: | PCR primers | SEQ ID NO: |
|---|---|---|
| 881 | 5'-TCCAGGCATATGAGCACAGTATATTTAAATGGCC-3'<br>5'-CCAGTAGCGGCCGCCTAACACTCAACACTATACTTATGC-3' | 994<br>995 |
| 883 | 5'-TCTAGGCATATGGTTTATCTGAACGGGCG-3'<br>5'-ACTGTAGCGGCGGCCTATCCGAGGGACGCGTTGG-3' | 996<br>997 |
| 895 | 5'-CATATGAAAGAGCTGGGCTATTACAACGGAAAAATC-3'<br>5'-GCGGCCGCCTATGACCTCCACCCCTGATTTCCAAAATAC-3' | 998<br>999 |
| 155 | 5'-CTAGGATTCCATATGAAGAATTCGCCGATCATC-3'<br>5'-CGAAGCTTCAACAGCGGCCGCTTAAAG-3' | 1000<br>1001 |

Site-Directed Mutagenesis

Site-directed mutagenesis was performed using QuikChange Multi Site-Directed Mutagenesis Kit (Stratagene, La Jolla, Calif.) according to the manufacturer's instructions. To generate the SEQ ID NO:870 T242N mutant, the pET30a untagged construct described in Example 10 was used as the template. To generate SEQ ID NO:220 G240N and SEQ ID NO:220 T241N mutants, the pET30a construct with a C-terminal his tag described in Example 10 was used as the template. The mutagenic primers used are listed below in Table 6. All the desired mutations were confirmed by DNA sequencing.

II-TOPO vector (Invitrogen). After the DNA sequences were verified by sequencing, the DAT genes were released from the TOPO plasmids by the digestion of NdeI and NotI and ligated into the pET30a vector which had been cut using the same restriction enzymes. DAT genes containing either an NdeI or NotI site internally were amplified using primers with compatible restriction enzyme sites and cloned into pET30a. For example, the DAT nucleic acid having the SEQ ID NO:155 (encoding the polypeptide having the sequence of SEQ ID NO:156) was reamplified from the original PCR product using NdeI and HindIII restriction sites for cloning into pET30a.

TABLE 6

Primer sequences

| Mutant polypeptide designation (SEQ ID NO:) | Sequence | SEQ ID NO: |
|---|---|---|
| 870 T242N | 5'-AATTATTTGTTTCATCAACAAATTCTGAAATTACGCCGGTTATTG-3' | 1002 |
| 220 G240N | 5'-CTTGTGTCCAGCAGCAACACACTCGGCCTTAG-3' | 1003 |
| 220 T241N | 5'-GTCCAGCAGCGGCAACCTCGGCCTTAGCGCC-3' | 1004 |

Cloning of DAT PCR Products in pET30a for the Expression as Untagged Protein

DAT nucleic acids having the sequences shown in SEQ ID NO:177, 179, 153, 165, 181, 217, 187, 189, 207, 219, 215, 195, 199, 197, 209, 201, 221, 235, 203, 237, 239, 223, 225, 227, 229, 231, 245, 213, 155, 169, 171, 167, 173, and 175 (encoding DAT polypeptides having the sequence shown in SEQ ID NO:178, 180, 154, 166, 182, 218, 188, 190, 208, 220, 216, 196, 200, 198, 210, 202, 222, 236, 204, 238, 240, 224, 226, 228, 230, 232, 246, 214, 156, 170, 172, 168, 174, and 176) were received as PCR products with Nde I and Not I compatible ends, as well as extraneous nucleotides to improve cutting efficiencies.

The DAT PCR products contained an NdeI restriction enzyme site at the 5' end and a NotI site at the 3' end. The PCR fragments were first cloned into pCR4 TOPO or pCR-Blunt Cloning of DATs in pET30a for the Expression as the C-His-Tagged Fusion Protein Nucleic acids encoding DAT 4978 and DAT 4978 T243N (described in Example 6), SEQ ID NO:870 (expressed from plasmid pSE420-cHis), and SEQ ID NO:870 T242N, SEQ ID NO:176 and SEQ ID NO:220 (untagged versions expressed from pET30) were re-amplified with Pfu Turbo (Stratagene) and primers that placed an XhoI site immediately upstream of the stop codons. PCR fragments were cloned into pCR-Blunt II-Topo (Invitrogen, Carlsbad, Calif.) as recommended by the manufacturer or directly cloned into the Nde I and Xho I restriction sites of pET30a The sequence was verified by sequencing (Agencourt, Beverly, Mass.) and an insert with the correct sequence was then released from the vector using Nde I and Xho I restriction enzymes and the insert was ligated into the Nde I and Xho I restriction sites of pET30a. See Table 7 for specific primers and plasmids names.

TABLE 7

Primer sequences

| Polypeptide designation (SEQ ID NO:) | Sequence | SEQ ID NO |
|---|---|---|
| 870 and | 5'-CATATGTATTCATTATGGAATGATCAAATAGTGAAGG-3' | 1005 |
| 870 T242N | 5'-CTCGAGTTTATTCGTAAAAGGTGTTGGAATTTTCGTTTC-3' | 1006 |
| DAT4978 and | 5'-CATATGAGTTATAGCTTATGGAATGACCAAATTGTGAATG-3' | 1007 |
| DAT4978T243N | 5'-CTCGAGTGCGCGAATACCTTTTGGGATTTTCGTATC-3' | 1008 |
| 220 | 5'-CTAGGATCTCATATGGACGCACTGGGATATTAC-3' | 1009 |
|  | 5'-GCCTCGAGTACCCTGCTCCACTCAGG-3' | 1010 |
| 176 | 5'-CTAGGATTCCATATGGACGCGCTTGGCTATTAC-3' | 1011 |
|  | 5'-GCCTCGAGTACCCTGCTCCACGCAG-3' | 1012 |

Cloning of CbDAT and CaDAT

A *Clostridium beijerinckii* D-amino-transferase was PCR amplified using Pfu Turbo (Stratagene) and *C. beijerinckii* genomic DNA with PCR primers containing a 5' NdeI and a 3' Nod restriction site. Genomic DNA was extracted from *C. beijerinckii* (ATCC 51743) using the Purrgene genomic DNA purification kit (Gentra Systems, Minneapolis, Minn.) per the manufacturer's instructions.

The 824 bp PCR product was gel extracted using a Qiagen Gel Extraction Kit and TOPO cloned into pCR-Blunt II-Topo (Invitrogen). After verifying the sequence, the gene was ligated to Nde I/Not I cut pET28b and pET30a vectors using a Rapid Ligation kit (Roche).

The *C. acetobutylicum* DAT was amplified by PCR using genomic DNA (ATCC 824) and the Stratagene Optiprime PCR Kit with PCR primers containing a 5' NdeI and a 3' NotI restriction site. The successful PCR reaction was cloned into the pCR4 TOPO vector and TOPO clones were sequenced. A positive TOPO clone was digested with restriction enzymes NdeI and NotI and the DAT fragment ligated into pET30a vector digested with the same restriction enzymes.

TABLE 8

Primer sequences

| Designation | Sequence | SEQ ID NO: |
|---|---|---|
| CbDAT1 | 5'-GGTTCATATGGAGAATTTAGGTTATTA-3' | 1013 |
|  | 5'-GGAAGCGGCCGCATATTCTACCTCCTATTCTG-3' | 1014 |
| CaDAT2 | 5'-GGTTCATATGAAAGATTTAGGATATTACAATGGAGAATAC-3' | 1015 |
|  | 5'GGAAGCGGCCGCTTAATTTGTTTCTTCCAAAAATTCATTAAG-3' | 1016 |

In Vitro Synthesis of LsDAT

The *Lactobacillus salivarius* DAT was assembled using a revised method based on Stemmer et al., 1995, *Gene*, 164: 49-53. Briefly, 43 oligonucleotides (primarily 40 mers) were ordered from IDT based on the gene sequence and its complementary DNA sequence, with 20 basepair overlaps between the sense and antisense strands. See Table 9 for the primer list. The primers were diluted to 250 µM in water and 5 µL of each primer was mixed together in a microfuge tube. PCR was carried out as follows: per 100 µL reaction, 1.5 µL of the primer pool, 4 µL dNTPs, 1× XL PCR buffer, 1 mM magnesium acetate, 2 µL rTth polymerase (Roche, Indianapolis, Ind.), and 0.25 µL Pfu polymerase (Stratagene, La Jolla, Calif.) were added. A 3 minute hot start was done at 94° C., followed by 15 cycles of 94° C. for 30 seconds, 42° C. for 30 seconds, and 68° C. for 15 seconds. Ten more cycles were done with an extension time of 30 seconds (at 68° C.). Ten more cycles were performed with an extension time of 75 seconds. Lastly, a chain extension step was done for seven minutes at 68° C.

TABLE 9

Oligos used to synthesis LsDAT

| Designation | Sequence (5' → 3') | SEQ ID NO: |
|---|---|---|
| F1: | ATGAAGCAAG TTGGATACTA CAATGGTACT ATCGCTGATT | 1017 |
| F2: | TAAATGAACT TAAGGTGCCT GCTACTGATC GTGCACTTTA | 1018 |
| F3: | TTTTGGTGAT GGTTGCTACG ATGCAACTAC ATTTAAGAAC | 1019 |
| F4: | AATGTTGCAT TTGCCTTAGA AGATCATCTT GATCGTTTTT | 1020 |
| F5: | ATAATAGTTG TCGCCTACTA GAGATCGATT TCCCTTTAAA | 1021 |
| F6: | TCGCGATGAA CTTAAAGAAA AGCTTTACGC TGTTATTGAT | 1022 |
| F7: | GCTAACGAAG TTGATACTGG TATCCTTTAT TGGCAAACTT | 1023 |
| F8: | CACGTGGTTC TGGTTTACGT AACCATATTT TCCCAGAAGA | 1024 |
| F9: | TAGCCAACCT AATTTATTAA TTTTTACTGC TCCTTATGGT | 1025 |
| F10: | TTAGTTCCAT TTGATACTGA ATATAAACTT ATATCTCGCG | 1026 |
| F11: | AAGACACTCG CTTCTTACAT TGCAATATTA AAACTTTGAA | 1027 |
| F12: | TTTACTTCCA AACGTTATTG CAAGTCAAAA GGCTAATGAA | 1028 |
| F13: | AGTCATTGCC AAGAAGTGGT CTTCCATCGC GGTGACAGAG | 1029 |
| F14: | TTACAGAATG TGCACACTCT AACATCTTAA TTCTAAAAGA | 1030 |
| F15: | TGGCGTTCTT TGCTCCCCAC CTAGAGATAA TTTAATCTTG | 1031 |
| F16: | CCAGGAATTA CTTTGAAACA TCTCTTGCAA TTAGCAAAAG | 1032 |
| F17: | AAAATAATAT TCCTACTTCC GAAGCACCAT TCACTATGGA | 1033 |
| F18: | TGATCTTAGA AATGCTGATG AAGTTATTGT TAGTTCTTCA | 1034 |
| F19: | GCTTGTCTAG GTATTCGCGC AGTCGAGCTT GATGGTCAGC | 1035 |
| F20: | CTGTTGGTGG AAAAGATGGA AAGACTTTAA AGATCTTGCA | 1036 |
| F21: | AGATGCTTAT GCTAAGAAAT ATAATGCTGA AACTGTAAGT CGTTAA | 1037 |
| R1: | TAGTATCCAA CTTGCTTCAT | 1038 |
| R2: | AGGCACCTTA AGTTCATTTA AATCAGCGAT AGTACCATTG | 1039 |
| R3: | CGTAGCAACC ATCACCAAAA TAAAGTGCAC GATCAGTAGC | 1040 |
| R4: | TCTAAGGCAA ATGCAACATT GTTCTTAAAT GTAGTTGCAT | 1041 |
| R5: | TAGTAGGCGA CAACTATTAT AAAAACGATC AAGATGATCT | 1042 |
| R6: | TTTCTTTAAG TTCATCGCGA TTTAAAGGGA AATCGATCTC | 1043 |
| R7: | CCAGTATCAA CTTCGTTAGC ATCAATAACA GCGTAAAGCT | 1044 |
| R8: | ACGTAAACCA GAACCACGTG AAGTTTGCCA ATAAAGGATA | 1045 |
| R9: | TTAATAAATT AGGTTGGCTA TCTTCTGGGA AAATATGGTT | 1046 |
| R10: | TCAGTATCAA ATGGAACTAA ACCATAAGGA GCAGTAAAAA | 1047 |

TABLE 9-continued

Oligos used to synthesis LsDAT

| Designation | Sequence (5' → 3') | SEQ ID NO: |
|---|---|---|
| R11: | ATGTAAGAAG CGAGTGTCTT CGCGAGATAT AAGTTTATAT | 1048 |
| R12: | CAATAACGTT TGGAAGTAAA TTCAAAGTTT TAATATTGCA | 1049 |
| R13: | ACCACTTCTT GGCAATGACT TTCATTAGCC TTTTGACTTG | 1050 |
| R14: | AGAGTGTGCA CATTCTGTAA CTCTGTCACC GCGATGGAAG | 1051 |
| R15: | GTGGGGAGCA AAGAACGCCA TCTTTTAGAA TTAAGATGTT | 1052 |
| R16: | TGTTTCAAAG TAATTCCTGG CAAGATTAAA TTATCTCTAG | 1053 |
| R17: | GGAAGTAGGA ATATTATTTT CTTTTGCTAA TTGCAAGAGA | 1054 |
| R18: | CATCAGCATT TCTAAGATCA TCCATAGTGA ATGGTGCTTC | 1055 |
| R19: | GCGCGAATAC CTAGACAAGC TGAAGAACTA ACAATAACTT | 1056 |
| R20: | TCCATCTTTT CCACCAACAG GCTGACCATC AAGCTCGACT | 1057 |
| R21: | ATTTCTTAGC ATAAGCATCT TGCAAGATCT TTAAAGTCTT | 1058 |
| R22: | TTAACGACTT ACAGTTTCAG CATTAT | 1059 |

A secondary amplification with primers L. sal DAT R Not I and L. sal DAT F Nde I (below) resulted in a band of the correct molecular weight. See Table 10 for these secondary amplification primer sequences.

TABLE 10

Primer sequences

| Designation | Sequence (5' → 3') | SEQ ID NO: |
|---|---|---|
| L. sal DAT R NotI | TTGGCCAAGCGGCCGCTTAACGACT TACAGTTT | 1060 |
| L. sal DAT F NdeI | GGTTCCAAGGCATATGAAGCAAGTT GGATACTA | 1061 |

The secondary PCR reaction was set up the same as above with the exception that only 2 primers were added. For the PCR template, 2.5 µl of the primary PCR reaction was used. A 3 minute hot start was done at 94° C., followed by 10 cycles of 94° C. for 30 seconds, 42° C. for 30 seconds, and 68° C. for 15 seconds. Ten more cycles were done with an increased annealing temp of 48° C. for 30 seconds with an extension time of 30 seconds (at 68° C.). Lastly, a chain extension step was done for seven minutes at 68° C.

The fragment was cloned into a pCR-BluntII-TOPO vector and the TOPO clones were sequenced. A positive TOPO clone was cut with NdeI and NotI and the DAT fragment ligated into pET30a vector digested with the same restriction enzymes.

Enzyme Preparation

E. coli strain BL21(DE3) was used as the host strain for the expression of DATs from pET-derived plasmids. E. coli strain TOP10 was used in all other DAT consructs. Single colonies of desired constructs were typically innoculated into Overnight Express II medium (Novagen) containing the appropriate amount of antibiotics. Following cultivation at 30° C. overnight, the cells were harvested by centrifugation when the $OD_{600}$ was greater than 10. Alternatively, overnight cultures were utilized to innoculate cultures in LB medium containing the appropriate antibiotics. The cultures were grown at 30° C. to an $OD_{600}$ of 0.5 to 0.9 and protein expression was induced with 1 mM IPTG for 4 h at the same temperature.

Cell extracts were prepared by adding 5 mL per g of cell pellet or 5 mL per 50 mL of overnight culture, of BugBuster® (primary amine-free) Extraction Reagent (EMD Biosciences/Novagen catalog #70923) with 5 µL/mL of Protease Inhibitor Cocktail II (EMD Bioscience/Calbiochem catalog #539132), 1 µl/ml of Benzonase® Nuclease (EMD Biosciences/Novagen catalog #70746), and 0.033 µl/ml of r-Lysozyme™ solution (EMD Biosciences/Novagen catalog #71110) to the cells. The cell resuspension was incubated at room temperature for 15 min with gentle shaking. Following centrifugation at 16,100 rcf for 20 min at 4° C., the supernatant was removed as the cell-free extract.

Prior to using the enzyme preparation for monatin reactions, detergents and low molecular weight compounds were removed from the cell-free extract by passage through a PD-10 column (GE Healthcare, Piscataway, N.J.) that was previously equilibrated with potassium phosphate buffer (100 mM, pH 7.8) or EPPS buffer (100 mM, pH 8.2) containing 0.05 mM of PLP. The protein was eluted using the equilibration buffer. Protein concentrations were typically determined using the BioRad Coomassie plate assay (also known as the Bradford assay) plate assay with BSA (Pierce) as the standard. Occasionally, the BCA (Pierce) microtiter plate assay was used for protein determination, where noted. To estimate the concentration of the D-aminotransferase in the cell-free extracts, 1 mg/mL samples were loaded on the Experion (Bio-Rad, Hercules, Calif.) electrophoresis system and the Experion Software (Version 2.0.132.0) was used to calculate the percentage of the soluble DAT protein in the cell-free extract. Alternatively, SDS-PAGE analysis was done and visual estimation was used to estimate percentage of expression.

The His-tagged fusion proteins were purified using either the GE Healthcare Chelating Sepharose Fast Flow resin or Novagen His-Bind columns. The purification using the Sepharose resin involved loading the cell-free extract onto a column that was previously equilibrated with potassium phosphate buffer (100 mM, pH 7.8) containing 200 mM of sodium chloride and 0.050 mM of PLP. The column was then washed successively using 3-5 column volumes of the equilibration buffer, 3-5 column volumes of the equilibration buffer containing 25 mM of imidazole and 3-5 column volumes of the equilibration buffer containing 50-100 mM of imidazole. The His-tagged protein was eluted off the column using 3-5 column volumes of the equilibration buffer containing 500 mM of imidazole. The eluate was concentrated using the Amicon (Billerica, Mass.) Centricon-70. The imidazole and sodium chloride salts in the concentrated protein solution were removed by passage through PD-10 desalting columns that were previously equilibrated using potassium phosphate buffer (100 mM, pH 7.8) (for DAT4978 and DAT4978 T243N) or EPPS buffer (100 mM, pH 8.2) (for SEQ ID NO:870 and SEQ ID NO:870 T242N) containing 50 µM of PLP. Protein concentrations were determined using Bio-Rad Protein Assay (Bio-Rad) and Albumin (Pierce) as a standard. Aliquots (0.5-1 mL) of the purified enzyme were stored at −80° C. until use. The purification of the His-tagged protein using the His-Bind columns followed the manufacture's instruction. The eluate from the column was desalted using the PD10 column as described above.

Example 5

Assay Procedures #2 for D-Aminotransferase Activity

Monatin Production Assay (Standard)

The following components were combined: 100 mM EPPS, pH 8.2; 200 mM sodium pyruvate; 100 mM of D-tryptophan; 50 µM PLP; 1 mM $MgCl_2$; 0.01% Tween-80; 50 µg/mL of aldolase described in Example 6 (cell-free extract was used; the aldolase concentration was estimated based on the percentage reading from Experion chip) and an appropriate amount of DAT (typically 0.1-1 mg/mL).

Except for the PLP stock solution and the protein solutions, all other reagents were made using oxygen-free deionized water and stored in the anaerobic chamber. The reactions were set up in the anaerobic chamber at room temperature with constant gentle mixing. To take a time point, formic acid was added into an aliquot of the reaction mixture to a final concentration of 2% (v/v). Following centrifugation at 16,100 RCF for 5 min using a bench-top microfuge, the supernantant was filtered through a 0.2 µm nylon membrane filter. Samples were then diluted 20- to 100-fold with water prior to analysis by LC/MS/MS.

D-tryptophan Transamination Assay

To compare the D-tryptophan transamination activities of certain D-aminotransferases, the following assays were performed. The assay mix contained: 0.5 mg/mL of cellular extract protein containing D-AT; 40 mM potassium phosphate pH 8.0; 20 mM D-tryptophan; 100 mM sodium pyruvate; and 50 µM PLP. The assays were incubated at 37° C. for 30 minutes and then placed on ice.

The extent of reaction was followed by measuring the amount of indole-3-pyruvate formed using the following assay: to 5 µl, 10 µl and 20 µl of reaction mix, 200 µl of the following solution was added: 0.5 mM sodium arsenate; 0.5 mM EDTA; and 50 mM sodium tetraborate (pH 8.5). Absorbance of the indole-3-pyruvate enol-borate complex at 325 nm was compared to a standard curve of indole-3-pyruvate prepared in the same solution.

Alanine formation can also be used to follow the extent of the D-tryptophan transamination reactions. Alanine concentrations were determined as described in Example 3.

R,R Monatin Transamination Assay

Assay conditions (final volume 2 mL) included: 0.01% Tween; 100 mM EPPS pH 8.2; 100 mM sodium pyruvate; approximately 3 mM R,R monatin; 0.5 mg/mL DAT; and 50 µM PLP. The extent of reaction was monitored by detection of alanine or R-MP formed using the protocols described in Example 3.

Example 6

Method for Obtaining DATs and an Aldolase

This method described the cloning of the aldolase used in monatin formation reactions with the D-aminotransferases, and D-aminotransferases previously isolated that were used for comparative purposes.

Aldolase

The aldolase used in monatin production assays from D-tryptophan was isolated and subcloned into pET vectors as described in WO 2007/103389 (referred to in that application as the aldolase of SEQ ID NO:276 encoded by the nucleic acid of SEQ ID NO:275).

DAT and DAT4978 T243N

A D-aminotransferase from ATCC #4978 (DAT 4978) was cloned as described in U.S. Publication No. 2006/0252135. A T243N mutant was made using the pET30 (untagged) DAT 4978 construct.

The primer for mutagenesis was designed following the suggestions listed in the Stratagene Multi-Change kit (La Jolla, Calif.). The primer was 5'-phosphorylated. Mutagenesis was done using the Stratagene Multi-Change kit following the manufacturer's instructions. The mutagenic oligonucleotide sequence is shown in Table 11.

TABLE 11

Mutagenic oligonucleotide sequences

| Mutant name | Amino acid change | Primer | SEQ ID NO: |
|---|---|---|---|
| DAT4978T243N | T243N | 5'-GTGATTGTTTCATCAACGAATTC AGAAGTAACGCC-3' | 1062 |

*E. coli* XL 10-Gold cells (Stratagene) were transformed and the resultant purified plasmid preparations were sequenced to verify that the correct mutations were incorporated. The plasmid containing the DAT 4978 T243N was then transformed into *E. coli* BL21 (DE3) expression host

*B. sphaericus* DAT

A D-aminotransferase from *B. sphaericus* (ATCC number 10208) was cloned as described in US 2006/0252135. The protein was prepared as described in the same reference.

Example 7

Analysis of DATs

DAT polypeptides having the sequence shown in SEQ ID NO:928, 930, 932, 934, 936, 938, 940, 942, 944, 946, 948, and 950 were produced by expressing the corresponding nucleic acid in the vectors and in the compatible *E. coli* expression hosts described in Example 2. One skilled in the art can synthesize the genes encoding these D-aminotransferases using assembly PCR techniques such as those described in Example 4. Overnight cultures in LB medium containing carbenicillin (100 μg/mL) were diluted 100× in 100 mL of the same medium and grown in a 500 mL baffled flask. The culture was grown at 30° C. to an $OD_{600}$ of 0.5 to 0.9, and protein expression was induced with 1 mM IPTG for 4 h at the same temperature. Samples for total protein were taken immediately prior to harvesting. Cells were harvested by centrifugation and washed once with 10 mL of potassium phosphate buffer pH 7.8. Cells were immediately frozen at −80° C. until cell extracts were prepared.

Cell extracts were prepared and desalted as described in Example 4 using 100 mM potassium phosphate as the buffer to elute and equilibrate the PD10 column. Total protein and DAT concentrations were determined as described.

Transamination of R,R monatin with pyruvate as the amino acceptor were performed as described in Example 5 except that 10 mM R,R monatin was utilized. Initial analyses of alanine, monatin, and monatin precursor levels were not consistent with each other and results were considered qualitative. The DAT polypeptide having the sequence of SEQ ID NO:948 appeared to show monatin precursor formation.

For further confirmation of activity, a monatin formation assay was done as described in the methods with a DAT concentration of approximately 0.2 mg/mL. As a control, 0.2 mg/mL concentration of purified *B. sphaericus* DAT was evaluated. After 2 and 21 hr, an aliquot was taken and formic acid was added to a final concentration of 2%, and the samples were frozen. Samples were then thawed, spun and filtered. Samples were analyzed for monatin using LC/MS/MS methodology and for tryptophan and alanine using the LC/OPA post-column fluorescence methodology described in Example 3. The DAT polypeptides having the sequence of SEQ ID NO:946 and 950 were capable of R,R monatin formation under the conditions tested. The DAT polypeptide having the sequence of SEQ ID NO:948 showed a loss of tryptophan and an increase in alanine formation, demonstrating its activity as a D-tryptophan transaminase. The DAT polypeptide having the sequence of SEQ ID NO:946 expressed well as determined by the amount of total protein but was not very soluble, which explains some inconsistent results. The DAT polypeptides having the sequence shown in SEQ ID NO:930, 932, 940, 942, and 944 did not yield visible bands on analysis with SDS-PAGE and, therefore, may be active if produced under different conditions. See Table 12 for results.

TABLE 12

Activity of DATs

| DAT Polypeptide (SEQ ID NO:) | Monatin [mM] Time = 2 hr | Monatin [mM] Time = 21 hr |
|---|---|---|
| 928 | nd | nd |
| 930 | nd | nd |
| 932 | nd | nd |
| 934 | nd | nd |
| 936 | nd | nd |
| 938 | nd | nd |
| 940 | nd | nd |
| 942 | nd | nd |
| 944 | nd | nd |
| 946 | 0.1 | 0.6 |
| 948 | nd | nd |
| 950 | 0.4 | 3.1 |
| *B. sphaericus* control DAT | 0.8 | 4.4 | nd = not detected under conditions tested

Analysis of DAT Polypeptides in pET30a

The DAT polypeptides having the sequence of SEQ ID NO:946, 948, and 950 were subcloned into pET30a as described in Example 4. Duplicate cultures of *E. coli* strain BL21 DE3 containing the DATs in pET30a were grown overnight in Overnight Express II (Solution 1-6, Novagen) at both 25 and 30° C. As a control, a strain containing pET30a plasmid without an insert was also grown. Cells were collected at an $OD_{600}$ of 5-10. Cells were harvested by centrifugation and washed once with 10 mL of 100 mM potassium phosphate buffer pH 7.8. Cells were frozen at −80° C. until further processed.

Cell extracts were prepared as described in Example 4 using 100 mM potassium phosphate as the buffer to elute and equilibrate the PD10 columns. Total protein and DAT protein concentrations were determined as described. The DAT polypeptide having the sequence of SEQ ID NO:946 expressed well at 30° C. in the total protein fraction, but was not soluble as viewed by SDS-PAGE. The DAT polypeptides having the sequence of SEQ ID NO:948 and 950 expressed at the higher temperature also, but were soluble.

A monatin formation assay was done as described in Example 5 except with a DAT concentration of 0.1 mg/mL for the polypeptide of SEQ ID NO:946 (0.5 mg/mL for all others). As a positive control, purified *B. sphaericus* DAT at a 0.5 mg/mL concentration was also assayed. After 2 and 21 hr, an aliquot was taken, formic acid was added to a final concentration of 2%, and the samples were frozen until further processed. Samples were then thawed, spun and filtered. Samples were analyzed for monatin using LC/MS/MS, and for tryptophan and alanine using LC/OPA post-column fluorescence detection methods described in Example 3. The results are shown in Table 13. D-tryptophan consumption and alanine formation were shown for all the D-aminotransferases tested indicating that they all have activity on D-tryptophan. Under these conditions, only DAT polypeptides having the sequence of SEQ ID NO:946 and 948 appeared to have activity for monatin formation. It is possible that expression or stability differences between the two host systems are the reason why activity is seen in some cases but not in others.

TABLE 13

| DAT polypeptide (SEQ ID NO) | Monatin [mM] time = 2 hr | Monatin [mM] time = 21 hr |
|---|---|---|
| pET30 (negative control) | nd | nd |
| 946 | 0.4 | 1.8 |
| 948 | nd | 0.2 |
| 950 | nd | nd |
| *B. sphaericus* positive control | 1.8 | 8.6 | nd, not detected under conditions tested

Example 8

Analysis of DATs in pSE420-cHis

DAT polypeptides having the sequence shown in SEQ ID NOs:886, 888, 890, 892 and 894 DATs were produced from the pSE420-cHis vector in *E. coli* HMS174. One skilled in the art can synthesize the genes encoding these D-aminotransferases using assembly PCR techniques such as those described in Example 4. Overnight cultures of the various DAT constructs were grown in LB medium containing ampicillin (100 μg/mL) at 30° C. Fifty mL of the same medium was inoculated the next day with 1 mL of the overnight cultures.

The cultures were grown at 30° C. until the OD$_{600\,nm}$ reached approximately 0.5 and then induced with 1 mM IPTG. The cultures were further incubated for 4 h at 30° C. and then harvested by centrifugation at 3800 rcf for 15 min. The cells were washed with 1.5 mL of 50 mM potassium phosphate, pH 7.0 and centrifuged again. The supernatant was decanted and the cell pellets were weighed.

Cell extracts were prepared as described in the methods using 100 mM potassium phosphate as the buffer to elute and equilibrate the column. Total and DAT concentrations were determined as described except BCA (Pierce) was used instead of Bradford for total protein determination. Two different vector only cultures were grown in the same E. coli hosts as the cloned DATs. All of the proteins produced visible bands on SDS-PAGE gels, but to differing degrees of solubility. Polypeptides having the sequence of SEQ ID NO:892 were not very soluble.

To compare the D-tryptophan transamination activities of each of the enzymes, the D-tryptophan transamination assay and the R,R monatin transamination assay described in Example 5 were performed. The D-tryptophan aminotransferase targeted using a final concentration of 0.5 mg/mL of cellular extract containing D-aminotransferase and 0.1 mg/mL of the purified B. sphaericus DAT as a control. Quantification of the DATs in the cellular extracts was difficult due to the low levels of soluble polypeptides. The DAT polypeptides having the sequence shown in SEQ ID NO:888, 892 and 894 showed good activity with D-tryptophan as a substrate during the minute reaction. DAT polypeptides having the sequence shown in SEQ ID NO:886 and 890 had measurable activity above the no-enzyme control, but exhibited little activity under the conditions tested.

Monatin transamination experiments were performed at room temperature, taking samples after 0.5, 1 and 2 hours targeting 0.5 mg/mL of each DAT, including the purified positive control from B. sphaericus. The R,R monatin transamination samples were then analyzed for monatin and alanine. The amount of monatin remaining was quantified by LC/MS/MS; alanine formation was measured using the post-column derivatization method in Example 3. Under the conditions tested, the DAT polypeptides having the sequence shown in SEQ ID NOs:892 and 894 were active. The DAT polypeptide having the sequence of SEQ ID NO:894 appeared to have the highest activity for conversion of R,R monatin to R-MP. The trends were consistent when alanine formation was assayed. The alanine production numbers (in mM) for the various timepoints are shown in Table 14.

TABLE 14

Alanine formation (mM) from R,R monatin transamination reactions

| DAT polypeptide (SEQ ID NO:) | 0.5 hr | 1 hr | 2 hr |
| --- | --- | --- | --- |
| vector control 1 | 0.139 | 0.185 | 0.215 |
| vector control 2 | 0.179 | 0.242 | 0.301 |
| 886 | 0.128 | 0.203 | 0.242 |
| 888 | 0.13 | 0.203 | 0.275 |
| 890 | 0.112 | 0.153 | 0.176 |
| 892 | 1.034 | 1.587 | 2.167 |
| 894 | 2.2 | 2.52 | 2.663 |
| BsphDAT(purified) | 0.287 | 0.519 | 0.894 |
| no enzyme | 0.043 | 0.035 | 0.037 |

DAT nucleic acids having the sequence shown in SEQ ID NO:891 and 893 were subcloned into pET30 as described in Example 4. These constructs were transformed into a variety of E. coli hosts carrying the DE3 lysogen for expression from a T7 promoter, including both K-12 and B strains of E. coli, and one strain that carried the pLysS plasmid. The clones were expressed in OvernightExpress System II as described in Example 4, with and without the addition of 0.5 mM pyridoxine, and analyzed by SDS-PAGE or Experion for expression. From these experiments, it became apparent that the proteins were expressing mostly in the insoluble fraction. Pyridoxine helped improve solubility to a small degree as did lowering the temperature from 37 to 30° C. for induction. Further work was done in cloning systems designed to maximize soluble expression (see Example 16-22).

Example 9

Analysis of CaDAT, CbDAT, and LsDAT in pET30a

The amino acid sequence shown in SEQ ID NO:894 was used to search for similar proteins available in the public databases. Three DATs were found that had similarity to SEQ ID NO:894. They were from Lactobacillus salivarus (47% identical at the protein level), Clostridium beijerinckii (57% identical at the protein level), and Clostridium acetobutylicum (60% identical at the protein level). The gene and protein sequences and their accession numbers are shown at the end of this example. FIG. 5 is an alignment (a sequence comparison) showing the consensus regions of these SEQ ID NO:894-like proteins of this invention. As highlighted in the figure, one can see a high degree of consensus regions indicating structural similarities.

These nucleic acids were cloned into pET30a, and the corresponding polypeptides expressed and tested for activity as described herein.

CbDAT

The D-aminotransferase from Clostridium beijerinckii (CbDAT) was cloned into pET30a (untagged) BL21 (DE3) and expressed using OVERNIGHT EXPRESS II™ (Novagen). The cells were collected at an optical density at 600 nm of approximately 9 and centrifuged at 4000 rcf for 15 min. The cells were washed once with 100 mM potassium phosphate pH 7.8 (cold), and spun again.

Cell extracts were prepared as described herein using 100 mM EPPS pH 8.2 as the buffer to elute and equilibrate the column. Total protein and DAT protein concentrations were determined as described except the BCA method (Pierce) was used instead of the Bradford (Coomassie) assay. The CbDAT expressed well but was only partially soluble.

A monatin formation assay was done as described in Example 5 but the activity of CbDAT (0.5 mg/mL) was also studied at pH 7.4 (with potassium phosphate as a buffer). As a control, purified B. sphaericus DAT (1 mg/mL) was assayed at pH 8.2. After 1, 2, 4, 8, and 23 hrs, aliquots were taken and formic acid was added to a final concentration of 2%. Samples were frozen at −80° C. until analyzed. Samples were then thawed, spun and filtered. Samples were analyzed for monatin using the LC/MS/MS methodology described in Example 3. Results are shown in Table 15. The amount of monatin produced were slightly higher for the assays carried out at pH 8.2. Similar experiments were performed with the polypeptides expressed from pET28 with an N-terminal His-tag. The activity of the tagged version appeared to be slightly less than that of the untagged, but still easily detectable.

TABLE 15

Activity over time

| DAT Enzyme | Monatin (ppm) 1 hr | Monatin (ppm) 2 hr | Monatin (ppm) 4 hr | Monatin (ppm) 8 hr | Monatin (ppm) 23 hr |
|---|---|---|---|---|---|
| CbDAT pET30 (7.4 mg/mL) | 45 | 126 | 280 | 428 | 502 |
| CbDAT pET30 (8.2 mg/mL) | 67 | 189 | 344 | 436 | 568 |
| B. sphaericus DAT (1 mg/mL) | 531 | 968 | 1742 | 2310 | 3706 |

CaDAT and LsDAT

The D-aminotransferases from *Lactobacillus salivarus* (LsDAT) and *Clostridium acetobutylicum* (CaDAT) were cloned into pET30a (untagged) BL21(DE3) and expressed using Overnight Express II (Novagen). The cells were collected when the culture reached an optical density at 600 nm of approximately 9 by centrifugation at 4000 rcf for 15 minutes.

Cell extracts were prepared as described herein using 100 mM EPPS pH 8.2 as the buffer to elute and equilibrate the column. Total protein and DAT protein concentrations were determined using the BCA (Pierce) protocol. Both enzymes expressed well and were soluble.

The assay was performed at room temperature under anaerobic conditions. As a control, purified *B. sphaericus* D-aminotransferase was assayed. Approximately 0.5 mg/mL of each DAT was used. After 0.5, 1, 2, 4, 6, 8 and 22 hr an aliquot was taken and formic acid added to a final concentration of 2% and the samples were frozen. Samples were then thawed, spun and filtered. Samples were analyzed for monatin using the LC/MS/MS methodology described in Example 3. Results are shown in Table 16.

TABLE 16

| DAT polypeptide | Monatin (ppm) 0.5 hr | Monatin (ppm) 1 hr | Monatin (ppm) 2 hr | Monatin (ppm) 4 hr | Monatin (ppm) 6 hr | Monatin (ppm) 8 hr | Monatin (ppm) 22 hr |
|---|---|---|---|---|---|---|---|
| B. sphaericus | 76.6 | 194.4 | 457.6 | 860.8 | 1186 | 1770 | 2546 |
| LsDAT | 2.8 | 6.4 | 14.6 | 33 | 52 | 69.8 | 173 |
| CaDAT | 50.2 | 141.2 | 318.6 | 543.4 | 612 | 1144 | 668 |

The homologs of the DAT having the sequence shown in SEQ ID NO:894 were active. Since the homologs showing the conserved sequence above were all active in monatin formation assays, it is expected that any D-aminotransferase containing the consensus sequences described herein would also be active, although their primary sequence identity is as low as 47%. There has been no evidence before this work that these unique D-aminotransferases, with low homology to the more characterized *Bacillus* D-aminotransferase, would have activity for monatin or would be broad specificity enzymes.

```
DNA Sequence CaDAT (ACCESSION AE001437 AE007513-AE007868; VERSION
AE001437.1 GI: 25168256; nucleotides 914049..914891)
                                                       (SEQ ID NO: 1063)
   1 atgaaagatt taggatatta caatggagaa tacgacttaa ttgaaaatat gaaaatacca 61 atgaatgatc gtgtatgcta ttttggtgat ggtgtttatg atgctactta tagtagaaac 121 cataatatat ttgcactaga tgagcatatt gaccgatttt ataatagtgc cgagctttta 181 agaattaaaa ttccatatac aaagaaggaa atgaaagagc ttttaaagga tatggttaaa 241 aaggttgata gcggagaaca atttgtatat tggcaggtta ctagaggtac tggcatgcgt 301 aatcatgctt ttttgagtga ggatgttaag gctaatattt ggattgtttt aaagccacta 361 aaggtaaaag atatgtcaaa aaaattaaaa ctaataacat tagaggatac tagattttta 421 cattgtaaca taaaaacctt aaatttgctt cctagtgtaa ttgcagcaca aaaaactgaa 481 gaagcaggct gccaggaagc agtatttcat agaggagata gagttactga atgtgctcat 541 agtaatgttt caattataaa ggatgagatt ttaaaaactg cgccaacaga taatcttatt 601 ttgccgggaa tagcaagggc gcatcttata aaaatgtgca aaaaatttga gatacctgta 661 gatgaaactc catttacatt aaaggagtta attaatgcgg atgaagttat agttacaagt 721 tcagggcaat tttgtatgac tgcttgtgag atagatggaa gacctgtagg cggaaaagcg 781 ccagatatta ttaaaaagct tcagactgcc ttacttaatg aattttggga agaaacaaat 841 taa
```

-continued

Protein Sequence CaDAT (ACCESSION NP_347428; VERSION NP_347428.1 GI: 15894079)

(SEQ ID NO: 1064)

```
  1 MKDLGYYNGE YDLIENMKIP MNDRVCYFGD GVYDATYSRN HNIFALDEHI DRFYNSAELL
 61 RIKIPYTKKE MKELLKDMVK KVDSGEQFVY WQVTRGTGMR NHAFLSEDVK ANIWIVLKPL
121 KVKDMSKKLK LITLEDTRFL HCNIKTLNLL PSVIAAQKTE EAGCQEAVFH RGDRVTECAH
181 SNVSIIKDEI LKTAPTDNLI LPGIARAHLI KMCKKFEIPV DETPFTLKEL INADEVIVTS
241 SGQFCMTACE IDGRPVGGKA PDIIKKLQTA LLNEFLEETN
```

DNA Sequence CbDAT (ACCESSION CP000721 AALO01000000 AALO01000001-AALO01000089 VERSION CP000721.1 GI: 149901357; nucleotides 3213484..3212636)

(SEQ ID NO: 1065)

```
  1 atggagaatt taggttatta taatggaaag tttggattat tagaggaaat gacagtacca
 61 atgcttgatc gtgtttgcta ttttggagat ggagtttatg atgctactta tagcagaaat
121 cacaagattt ttgcattgga ggagcatatt gaaagatttt acaacagcgc tggtttatta
181 ggaattaaaa ttccttattc aaaggagcaa gtaaagaaa tccttaagga tggtatta
241 aaggttgatt caggagaaca atttgtatat tggcaaatta ctagaggaac tggaatgaga
301 aatcatgctt ttcctggaga tgaggtccct gcaaatctat ggattatgtt aaagcccttta
361 aatattaagg atatgtcaca aaaattaaag ttaatcactt tagaagacac tagattttta
421 cactgtaata tcaaaacctt aaatttatta ccagtgtaa ttgcatctca aaaaactgaa
481 gaggcaggat gtcaggaagc tgtatttcat agagggata gagtaactga atgtgcacat
541 agcaatgtat caattattaa ggatggtata ttaaaaactg ctccaacaga caatttaatt
601 ttaccaggta tagcaagagc tcaccttatt aaaatgtgta aatcctttaa tattcctgta
661 gatgaaacag catttacctt gaaggaatta atggaggcag atgaagttat agttactagt
721 tcaggtcaat tttgtatggc aaccagtgaa atagatggaa tacctgtagg gggaaaagca
781 ccagagcttg taagaaaatt acaagatgca ttgttaaatg agttcttaga agaaacaaaa
841 acagaatag
```

Protein Sequence CbDAT (ACCESSION YP_001309869 VERSION YP_001309869.1 GI: 150017615)

(SEQ ID NO: 1066)

```
  1 MENLGYYNGK FGLLEEMTVP MLDRVCYFGD GVYDATYSRN HKIFALEEHI ERFYNSAGLL
 61 GIKIPYSKEQ VKEILKEMVL KVDSGEQFVY WQITRGTGMR NHAFPGDEVP ANLWIMLKPL
121 NIKDMSQKLK LITLEDTRFL HCNIKTLNLL PSVIASQKTE EAGCQEAVFH RGDRVTECAH
181 SNVSIIKDGI LKTAPTDNLI LPGIARAHLI KMCKSFNIPV DETAFTLKEL MEADEVIVTS
241 SGQFCMATSE IDGIPVGGKA PELVKKLQDA LLNEFLEETK TE
```

DNA Sequence LsDAT (ACCESSION CP000233 VERSION CP000233.1 GI: 90820184; nucleotides 1750082..1750927)

(SEQ ID NO: 1067)

```
  1 atgaagcaag ttggatacta caatggtact atcgctgatt taatgaact taaggtgcct
 61 gctactgatc gtgcacttta ttttggtgat ggttgctacg atgcaactac atttaagaac
121 aatgttgcat tgccttaga agatcatctt gatcgttttt ataatagttg tcgcctacta
181 gagatcgatt tccctttaaa tcgcgatgaa cttaaagaa gctttacgc tgttattgat
241 gctaacgaag ttgatactgg tatcctttat tggcaaactt cacgtggttc tggtttacgt
301 aaccatattt tcccagaaga tagccaacct aatttattaa ttttttactgc tccttatggt
361 ttagttccat tgatactga atataaactt atatctcgcg aagacactcg cttcttacat
421 tgcaatatta aaactttgaa tttacttcca acgttattg caagtcaaaa ggctaatgaa
481 agtcattgcc aagaagtggt cttccatcgc ggtgacagag ttacagaatg tgcacactct
```

```
-continued
541 aacatcttaa ttctaaaaga tggcgttctt tgctccccac ctagagataa tttaatcttg 601 ccaggaatta ctttgaaaca tctcttgcaa ttagcaaaag aaaataatat tcctacttcc 661 gaagcaccat tcactatgga tgatcttaga aatgctgatg aagttattgt tagttcttca 721 gcttgtctag gtattcgcgc agtcgagctt gatggtcagc ctgttggtgg aaaagatgga 781 aagactttaa agatcttgca agatgcttat gctaagaaat ataatgctga aactgtaagt 841 cgttaa Protein Sequence LsDAT (ACCESSION YP_536555 VERSION YP_536555.1
GI: 90962639)
                                                        (SEQ ID NO: 1068)
  1 MKQVGYYNGT IADLNELKVP ATDRALYFGD GCYDATTFKN NVAFALEDHL DRFYNSCRLL

61 EIDFPLNRDE LKEKLYAVID ANEVDTGILY WQTSRGSGLR NHIFPEDSQP NLLIFTAPYG

121 LVPFDTEYKL ISREDTRFLH CNIKTLNLLP NVIASQKANE SHCQEVVFHR GDRVTECAHS

181 NILILKDGVL CSPPRDNLIL PGITLKHLLQ LAKENNIPTS EAPFTMDDLR NADEVIVSSS

241 ACLGIRAVEL DGQPVGGKDG KTLKILQDAY AKKYNAETVS R
```

Example 10

Analysis of DATs

HMS174 *E. coli* containing the DAT nucleic acids having the sequence of SEQ ID NO:865, 867, 869, 871, 873, 875, and 877 in vector pSE420-cHis were obtained and streaked on agar plates containing LB medium with ampicillin. One skilled in the art can synthesize the genes encoding these D-aminotransferases using assembly PCR techniques such as those described in Example 4. Single colonies were used to inoculate 3 mL of LB medium containing ampicillin (100 μg/mL). Five hundred μl of the overnight culture was used to inoculate 50 mL of the same medium in 250 mL baffled flasks. The cells were grown at 30° C. to approximately an $OD_{600nm}$ of 0.5. IPTG was added to a final concentration of 1 mM. Cells were induced at 30° C. for 4 hours and collected by centrifugation.

Cell extracts were prepared as described in Example 4. Total protein and DAT concentrations were determined as described in Example 4. The DATs all appeared to express well, and most of them showed a high degree of solubility.

A monatin formation assay was done as described in Example 5 except with a DAT concentration of 0.1 mg/mL and the aldolase at a concentration of 10 μg/mL. As a control, 0.1 mg/mL of purified *B. sphaericus* DAT was assayed. After 6 and 22 hours, an aliquot was taken and formic acid added to a final concentration of 2%, and the samples were frozen. Samples were then thawed, spun and filtered. Samples were analyzed for monatin concentrations using the LC/MS/MS methodology described in Example 3. Under the conditions tested, SEQ ID NO:870, 874 and 878 all appeared to have high activity in the 3-step monatin formation assay. DAT polypeptides having the sequences shown in SEQ ID NOs: 866, 872, and 876 also had activity in the monatin formation pathway but not to the same extent as did polypeptides having the sequence shown in SEQ ID NOs:870, 874 and 878 under the conditions tested. Table 17 shows the results for monatin formation (in ppm).

TABLE 17

Monatin formation assay

| DAT polypeptide (SEQ ID NO:) | 6 hr | 22 hr |
|---|---|---|
| 866 | 17.4 | 76 |
| 868 | nd | nd |
| 870 | 132 | 836 |
| 872 | 13.8 | 50 |
| 874 | 281.6 | 798 |
| 876 | 2.4 | 12 |
| 878 | 223.4 | 576 |
| *B. sphaericus* DAT | 175.6 | 616 | nd, not detected under conditions tested

Further Analysis of Polypeptides Having the Sequence of SEQ ID NO:870, 874 and 878 in pET30a Cultures of *E. coli* BL21 DE3 transformed with pET30a plasmids containing nucleic acids encoding the above-indicated DATs were grown overnight in 50 mL of Overnight Express II (Solution 1-6, Novagen) at 30° C. As a positive control, a strain containing the DAT from ATCC #4978 in pET30a was also grown and induced (described in Example 6). Cells were collected at an $OD_{600nm}$ of 5-10, harvested by centrifugation and frozen at −80° C. until further processed.

Cell extracts were prepared as described in the Example 4. Total protein and DAT concentrations were determined as described in Example 4.

A monatin formation assay was done as described in Example 5 except with a DAT polypeptide concentration of 0.5 mg/mL for SEQ ID NO:870 and a concentration of 0.275 mg/mL for each of SEQ ID NO:874 and 878. As a control, DAT4978 and purified *B. sphaericus* DAT were assayed at 0.5 mg/mL concentration. After 0.5, 1, 2, 4, 6.5, 9, 24 and 22 hr, an aliquot was taken and formic acid added to a final concentration of 2% and the samples were frozen. Samples were then thawed, spun and filtered. Samples were analyzed for monatin using the LC/MS/MS methodology described in Example 3. The results are shown in Table 18 (in ppm of monatin formed).

TABLE 18

| DAT polypeptide (SEQ ID NO:) | 0.5 hr | 1 hr | 2 hr | 4 hr | 6.5 hr | 9 hr | 24 hr |
|---|---|---|---|---|---|---|---|
| 4978 DAT | 18 | 85.6 | 283.4 | 673.2 | 890 | 1226 | 2020 |
| 870 | 14.4 | 71 | 279.4 | 736 | 1340 | 1680 | 3362 |
| 874 | 63.8 | 182.6 | 415.6 | 674 | 888 | 938 | 1154 |
| 878 | 97.8 | 244.4 | 607 | 912.2 | 1068 | 1174 | 1356 |
| *B. sphaericus* | 44.6 | 142.8 | 375.2 | 813 | 1294 | 1382 | 2746 |

All three of the subcloned DATs (encoding polypeptides having the sequence of SEQ ID NO:870, 874, and 878) expressed well in the pET system and yielded soluble protein. The polypeptide having the sequence shown in SEQ ID NO:870 gave the highest amount of expression in the soluble fraction and exhibited high activity that did not appear to diminish over time in comparison to the DAT polypeptides having the sequence of SEQ ID NO:874 and 878.

Comparison Between Wild Type and Mutant DAT Polypeptides

A mutant polypeptide in which the residue of SEQ ID NO:870 was changed from a T to a N (SEQ ID NO:870 T242N) was constructed as described in Example 4 and expressed and compared to DAT4978, DAT4978 T243N (described in Example 6), *B. sphaericus* and wildtype SEQ ID NO:870.

Cultures of BL21 DE3 in which the wild type and mutant polypeptides having the sequence of SEQ ID NO:870, 870 T242N, DAT4978 and DAT4978 T243N were expressed from the pET30a vector, were grown in 50 mL of Overnight Express (Novagen) in a 250 mL baffled flask overnight at 30° C. and 250 rpm. The cells were collected by centrifugation when they reached an optical density at 600 nm of over 10. Cell extracts were prepared as described in Example 4, and total protein and DAT concentrations were determined as described in Example 4. All of the DATs tested were highly expressed and soluble, all near 30% as determined using the Experion software. The polypeptide having the sequence of SEQ ID NO:870 T242N had the highest expression, which was predicted to be 36.3% of the total soluble protein.

A monatin formation assay was done as described in Example 5 at a DAT polypeptide concentration of 0.5 mg/mL. As a control, 0.5 mg/mL of purified *B. sphaericus* DAT was assayed. After 0.5, 1 2, 4, 6.5, 9 and 23.25 hr, an aliquot was taken, formic acid added to the aliquot to a final concentration of 2% and the samples frozen. Samples were then thawed, spun and filtered. Samples were analyzed for monatin, tryptophan, alanine and 4-hydroxy-4-methyl glutamic acid (HMG) as described in Example 3.

In the last time point, an additional aliquot was taken to determine % R,R monatin by the FDAA-derivatization method described in Example 3.

Monatin formation numbers (ppm) are presented in Table 19 below. The percent R,R is given in the right-hand column, for the 23.25 hr timepoint.

TABLE 19

| DAT polypeptide (SEQ ID NO:) | 0.5 hr | 1 hr | 2 hr | 4 hr | 6.5 hr | 9 hr | 23.25 hr | % R,R |
|---|---|---|---|---|---|---|---|---|
| Wild type DAT 4978 | 11 | 57 | 216 | 472 | 694 | 942 | 1616 | 95.0 |
| 4978 T243N | 74 | 237 | 542.6 | 1106 | 1396 | 1784 | 2202 | 99.0 |
| 870 | 15.6 | 74.4 | 269.6 | 702 | 1250 | 1522 | 2788 | 97.8 |
| 870 T242N | 49.4 | 194 | 655.2 | 1496 | 2212 | 2666 | 3670 | 99.5 |
| *B. sphaericus* | 40.6 | 144 | 372 | 800 | 1090 | 1458 | 2434 | 97.2 |

The activity of the T242N mutant of the SEQ ID NO:870 polypeptide was very high, and was better than the positive controls and higher than the wildtype form of DAT polypeptides. The percentage of R,R monatin formed by this mutant was also higher than any of the other benchmark enzymes. The analysis of the amount of HMG (a by-product) formed is qualitative, but it appears that, at the 9 hour and 23.25 hour timepoints, similar amounts of HMG were formed by DAT 4978 T243N polypeptides and SEQ ID NO:870 T242N polypeptides.

The exemplary DAT polypeptide of this invention having the sequence shown in SEQ ID NO:870 is a novel protein, exhibiting 76% sequence identity to the closest known D-aminotransferase (*Bacillus* YM-1 D-aminotransferase) and 69% amino acid sequence identity to the *B. sphaericus* DAT described in Example 6. FIG. 6 shows an alignment of this novel enzyme of the invention with other published DATS, and one can see the residues are one property that makes this enzyme unique and may account for its superior activity.

The highly active DAT polypeptide having the sequence shown in SEQ ID NO:910 (more similar to *B. sphaericus* type DATs; see Example 12) is also shown in the alignment. As an example of the uniqueness of the SEQ ID NO:870 polypeptide, in the region surrounding amino acid residue 54-55 (*B. sphaericus* numbering) in the alignment of FIG. 6, it is clear that the *Bacillus*-like DATs have a high degree of conservation whereas SEQ ID NO:870 has the residues EC rather than AS. As another example, in the highly conserved region surrounding residue 135 of the alignment shown in FIG. 6, the SEQ ID NO:870 polypeptide has a more hydrophilic residue (T) versus predominantly valine residues. The core sequence that represents the SEQ ID NO:870 enzyme, but excludes previously known broad specificity D-aminotransferases and highly related homologs, is shown as Consensus Sequences A and B. It is expected that any polypeptide containing one of these consensus sequences would exhibit DAT activity and be active in monatin formation pathway steps.

```
Consensus Sequence A
                                                    (SEQ ID NO: 1069)
Y.*LWND.*IV.*EDRGYQFGDG.*YEV.*KVY.*G.*FT.*EH.*DR.*YECAEKI.*PYTK.

*H.*LLH.*L.*E.*N.*TG.*YFQ.*TRGVA.*RVHNFPAGN.*Q.*V.*SGT.*K.*F.*R.*N.*

KGVKAT.*TED.*RWLRCDIKSLNLLGAVLAKQEAIEKGCYEA.*LHR.*G.*TE.*SS.

*N.*GIK.*GTLYTHPA.*N.*ILRGITR.*V.*TCAKEIE.*PV.*Q.*T.*K.*LEMDE.*V.*S.

*SE.*TP.*I.*DG.*KI.*NG.*G.*WTR.*LQ.*F.*K.*P.
```

```
Consensus Sequence B
                                                                   (SEQ ID NO: 1070)
Y[ST]LWND[QK]IV.[DE].{2}[VI].[IV].{2}EDRGYQFGDG[IV]YEV[IV]KVY[ND]G.

[ML]FT.{2}EH[IV]DR.YECAEKI[RK][LIV].[IV]PYTK.{3}H[QK]LLH.L[VI]E.N.[LV].

TG[HN][IVL]YFQ[IV]TRGVA.RVHNFPAGN[VI]Q.V[LI]SGT.K.F.R.{3}N.[EQ]KGV

KAT.TED[IV]RWLRCDIKSLNLLGAVLAKQEAIEKGCYEA[IV]LHR.G.[VI]TE.SS.N

[VI][FY]GIK[DN]GTLYTHPA[ND]N.ILRGITR.V[IV][LI]TCAKEIE[LMI]PV.[EQ]Q.

{2}T.K.{2}LEMDE[LIVM].V[ST]S.[TS]SE[IV]TP[VI]I[DE][IVL]DG.KI.NG.{2}G[ED]

WTR[KQ]LQ.{2}F.{2}K[IL]P..
```

Similar to PERL regular expression convention language, ".*" indicates that any number of amino acid residues may be present from any of the 20 proteinogenic amino acids; [ ] indicates that any one of the amino acids in the brackets can be present; ".{#}" indicates that any of the 20 proteinogenic amino acids can be present as long as the number of residues matches the number {#} indicated in the brackets.

With respect to the use of ".*" in Consensus sequence A, the number of amino acids at any of the ".*" positions can vary, for example, from 0 to about 20 residues (see, for example, Consensus sequence B (SEQ ID NO:1070)) or from about 20 residues up to about 100 residues, or the number of amino acids can be much larger, for example, up to 1000 or more residues. Without limitation, an insertion at one or more of the ".*" positions can correspond to, for example, a domain such as (but not limited to) a chitinase binding domain (e.g., from *Pyrococcus furiosus* (Accession No. 2CZN_A) or *P. burkholderia* (Accession No. YP_331531) or a cellulose binding domain (e.g., from *Cellulomonas fimi* (Accession No. 1EXH_A) or *Clostridium stercorarium* (Accession No. 1UY1_A). In some embodiments (without limitation), five or less of the positions designated ".*" each contain an insertion of, for example, greater than about 20 residues (e.g., greater than about 100 residues). In other embodiments (without limitation), five or more of the positions designated ".*" each contains an insertion of less than about 100 residues (e.g., less than about 20 residues, e.g., 3, 5, 10, 20, 25, 30, 40, 50, 60, 70, 75, 80, 90 or 95 residues)). The activity of a polypeptide having a sequence that corresponds to one or more of the consensus sequences disclosed herein and containing any number of residues inserted at one or more of the ".*" positions can be evaluated using methods that are described herein.

Non-limiting representative polypeptides that contain the consensus sequence shown in SEQ ID NO:1069 include the polypeptide having the sequence shown in SEQ ID NO:870 and Consensus sequence B (SEQ ID NO:1070).

Comparison Between SEQ ID NO:870, 870 T242N, DAT 4978 and DAT 4978 T243N, Tagged and Untagged

*E. coli* BL21 DE3 cells expressing the polypeptides having the sequence of SEQ ID NO:870, 870 T242N, DAT 4978 and DAT 4978 T243N were grown in 50 mL of Overnight Express (Novagen) in a 250 mL baffled flask overnight at 30° C. and 250 rpm. The cells were collected by centrifugation when the optical density at 600 nm was greater than 10. Cell extracts were prepared as described in Example 4. Total protein and DAT concentrations were determined as described in Example 4.

*E. coli* BL21 DE3 cultures expressing C-terminal tagged SEQ ID NO:870, 870 T242N, DAT 4978 and DAT 4978 T243N polypeptides were grown in 200 mL of Overnight Express (Novagen) in a 1000 mL baffled flask overnight at 30° C. and 250 rpm. Two cultures of each clone were grown. The cells were pooled and collected by centrifugation when at an optical density at 600 nm of over 10. Cell extracts were created by the addition of 50 mL of Bug Buster Primary Amine Free (Novagen) with 50 µl of Benzonase Nuclease (Novagen), 0.75 µl of rLysozyme (Novagen), and 250 µl of Protease Inhibitor Cocktail II (Calbiochem). The cells were incubated for 15 minutes at room temperature with gentle rocking. The extracts were centrifuged at 45,000×g for 10 minutes.

The His-tagged proteins were purified as described in the methods section using GE Healthcare (Piscataway, N.J.) Chelating Sepharose™ Fast Flow resin. The purified protein was desalted using a PD10 column into 100 mM potassium phosphate, pH 7.8 (for DAT 4978 and DAT 4978 T243N polypeptides) or 100 mM EPPS pH 8.2 (for SEQ ID NO:870 and 870 T242N polypeptides), both buffers contained 50 µM PLP.

An R,R monatin formation assay was performed as described in Example 5 with a DAT concentration of 0.5 mg/mL. Aliquots were taken at 2.25, 4.5, 9 and 24 hours, pH adjusted with formic acid, and frozen. An extra aliquot was taken at the final time point without formic acid addition for determination of stereoisomeric distribution using the FDAA derivatization method described in Example 3. The samples were thawed and centrifuged for 5 minutes and the supernatant filtered with a 0.2 µm nylon membrane filter. Samples were submitted for monatin analysis using the LC/MS/MS method described in Example 3. The results are shown in Table 20, in ppm monatin formed. The far right column is the % R,R monatin formed at the end of the experiment.

TABLE 20

| DAT polypeptide (SEQ ID NO:) | 2.25 hr | 4.5 hr | 9 hr | 24 hr | % R,R |
|---|---|---|---|---|---|
| DAT 4978 | 330 | 676 | 1470 | 2384 | 92.3 |
| DAT 4978 T243N | 1392 | 2856 | 4068 | 3688 | 98.2 |
| 870 | 395 | 952 | 1896 | 2998 | 97.8 |
| 870 T242N | 1416 | 2936 | 3868 | 3976 | 99.3 |
| DAT 4978 6xHis tagged | 362 | 887 | 1664 | 2818 | 96.5 |
| DAT 4978 T243N 6xHis tagged | 1364 | 2298 | 3464 | 4440 | 98.9 |
| 870 6xHis tagged | 228 | 688 | 1508 | 3138 | 98.1 |
| 870 T242N 6xHis tagged | 746 | 2020 | 3962 | 4552 | 99.5 |

The overall activity and stereo specificity of the C-terminally tagged and untagged enzymes are very similar. In addition, it is expected that the presence of activity in a polypeptide encoded from a subcloned nucleic acid is predictive of the presence of activity in the corresponding polypeptide encoded from the full-length or wild type nucleic acid.

Example 11

Analysis of DATs

E. coli HMS174 containing DAT nucleic acids in the pSE420-cHis vector encoding the polypeptides having the sequence of SEQ ID NO:880, 882, and 884 were streaked onto agar plates containing LB medium with ampicillin. One skilled in the art can synthesize the genes encoding these D-aminotransferases using assembly PCR techniques such as those described in Example 4. Single colonies were used to innoculate 3 mL of LB medium containing ampicillin (100 µg/mL). Five hundred p. 1 was used to inoculate 50 mL of the same medium in a 250 baffled flask. The cells were grown at 30° C. to approximately an $OD_{600nm}$ of 0.4, and IPTG was added to a final concentration of 1 mM. Cells were grown at 30° C. for 4 hours and collected by centrifugation.

Cell extracts were prepared as described in the Example 4. Total protein and DAT polypeptide concentrations were determined as described in Example 4. SEQ ID NO:882 and 884 expressed well and were present at high levels in the soluble fraction.

An R,R monatin formation assay was performed as described in Example 5 using approximately 0.5 mg/mL of each DAT polypeptide (except that 0.35 mg/mL of the SEQ ID NO:880 polypeptide was utilized). After 2, 8, and 23 hours, an aliquot was taken, formic acid was added to a final concentratin of 2%, and the samples were frozen. Samples were then thawed, spun and filtered. Samples were analyzed for monatin using the LC/MS/MS methodology described in Example 3. Results are shown in Table 21.

At the last time point, an extra aliquot was taken (without pH adjustment) to determine the stereoisomeric distribution of the monatin produced using the FDAA derivatization methodology described in Example 3. The percentage of R,R produced is shown in the right hand column of Table 18 below, the balance is predominantly S,R monatin.

TABLE 21

| Polypeptide (SEQ ID NO:) | monatin ppm (2 hr) | monatin ppm (8 hr) | monatin ppm (23 hr) | % R,R (23 hr) |
|---|---|---|---|---|
| 880 | 31.6 | 140 | 176 | 97.5 |
| 882 | 31.6 | 872 | 2790 | 99.3 |
| 884 | 79.4 | 644 | 1610 | 100 |
| B. sphaericus | 337 | 1518 | 2538 | 96.7 |

Polypeptides having the sequence shown in SEQ ID NO:882 and 884 exhibited good activity in the monatin formation reactions from D-tryptophan.

The stereopurity of the monatin produced was higher when using these DATs as compared to the B. sphaericus control enzyme. The DAT nucleic acids encoding DAT polypeptides having the sequence of SEQ ID NO:882 and 884 were subcloned into pET30a vectors as described in Example 4. Analysis of DAT Polypeptides Having the Sequence of SEQ ID NO:882 and 884 Expressed from the pET30a Vector Cultures of E. coli BL21 DE3 containing nucleic acids encoding DAT polypeptides having the sequence of SEQ ID NO:882 and 884 in the pET30a vector were grown in 50 mL of Overnight Express (Novagen) in a 250 mL baffled flask overnight at 30° C. and 250 rpm. The cells were collected by centrifugation when the optical density at 600 nm was greater than 10.

Cell extracts were prepared as described in Example 4. Total protein and DAT polypeptide concentrations were determined as described. Total and soluble protein samples were analyzed using a 4-15% gradient acrylamide gel as well as by the Experion system. Expression was predicted to be approximately 30% by the Experion software. Visible bands were seen for both the total protein and soluble protein (cell-free extract) fractions.

A monatin formation assay was performed as described in Example 5 with both 0.5 and 2 mg/mL DAT polypeptide concentrations. Purified B. sphaericus DAT was used as a control. After 2, 4.5, 9, 24, 36 and 48 hrs, an aliquot was taken, formic acid was added to a final concentration of 2%, and the samples were frozen. Samples were then thawed, spun and filtered. Samples were analyzed for monatin using the LC/MS/MS methodology described in Example 3. The samples were qualitatively analyzed for HMG levels. Additional aliquots were taken (without pH adjustment) for stereoisomeric analysis using the FDAA derivatization methodology described in Example 3. The results are shown in Tables 22 and 23.

TABLE 22

| DAT polypeptide (SEQ ID NO:) | Monatin (ppm) 2 hrs | Monatin (ppm) 4.5 hrs | Monatin (ppm) 9 hrs | Monatin (ppm) 24 hrs | Monatin (ppm) 36 hrs | Monatin (ppm) 48 hrs |
|---|---|---|---|---|---|---|
| 882 (0.5 mg/mL) | 61 | 274 | 780 | 1802 | 2172 | 2170 |
| 882 (2 mg/mL) | 985 | 2452 | 3232 | 3128 | 3082 | 3158 |
| 884 (0.5 mg/mL) | 149 | 362 | 656 | 1394 | 1756 | 2158 |
| 884 (2 mg/mL) | 811 | 1628 | 2466 | 2988 | 3178 | 2864 |
| B. sphaericus (0.5 mg/mL) | 362 | 860 | 1268 | 2362 | 2532 | 2804 |
| B. sphaericus (2 mg/mL) | 1335 | 2344 | 3154 | 3866 | 3842 | 4008 |

TABLE 23

Stereopurities of monatin produced at selected timepoints

| DAT polypeptide (SEQ ID NO:) | 24 hrs (% R,R) | 48 hrs (% R,R) |
|---|---|---|
| 882 (2 mg/mL) | 95.4 | 94.1 |
| 884 (2 mg/mL) | 99.6 | 99.4 |
| Bs DAT (2 mg/mL) | 95.8 | 93.3 |

Polypeptides having the sequence shown in SEQ ID NO:882 and 884 exhibited good monatin formation activity and stereospecifiity, and appeared to produce less HMG than the B. sphaericus control during the initial timepoints. Polypeptides having the sequence of SEQ ID NO:882 exhibited similar initial monatin formation rates but appeared to have plateaued in this experiment at a lower monatin titer.

Example 12

Analysis of DATs in pSE420-cHis, and of a DAT in pET30a

The open reading frames encoding DAT polypeptides having the sequence of SEQ ID NO:898, 900, 902, 904, 906, 910, and 896 were evaluated. One of ordinary skill in the art can synthesize the genes encoding these D-aminotransferases using assembly PCR techniques such as those described in Example 4.

A culture of E. coli BL21 DE3 containing a nucleic acid encoding a DAT polypeptide having the sequence shown in SEQ ID NO:896 in the pET30a vector (subcloned as described in Example 4) was grown in 50 mL of Overnight Express (Novagen) in a 250 mL baffled flask overnight at 30° C. and 250 rpm. The cells were collected by centrifugation when the optical density at 600 nm was greater than 10.

Top10 (Invitrogen, Carlsbad, Calif.) E. coli cells were transformed with the pSE420-cHis plasmid containing the DAT nucleic acids having the sequence shown in SEQ ID NO:897, 899, 901, 903, 905, and 909 and plated on LB medium containing ampicillin (100 µg/mL). Five hundred µl of an overnight culture was used to inoculate 50 mL of the same medium in a 250 baffled flask. The cells were grown at 30° C. to an $OD_{600nm}$ of approximately 0.4 and IPTG was added to a final concentration of 1 mM. Cells were grown at 30° C. for 4 hours and collected by centrifugation.

Cell extracts were prepared as described in Example 4. Soluble protein and estimated DAT concentrations were determined as described in Example 4.

An R,R monatin formation assay was performed as described in Example 5 with DAT polypeptide concentrations of 0.5 mg/mL, except that 0.3 mg/mL of the polypeptide having the sequence of SEQ ID NO:896 was used; 0.06 mg/mL of the polypeptide having the sequence of SEQ ID NO:898 was used; 0.4 mg/mL of the polypeptide having the sequence shown in SEQ ID NO:900 was used; 0.1 mg/mL of the polypeptide having the sequence of SEQ ID NO:902 was used; and 0.12 mg/mL of the polypeptide having the sequence of SEQ ID NO:904 was used. As positive controls, SEQ ID NO:870, 870 T242N, and purified B. sphaericus were tested at DAT polypeptide concentrations of 0.5 mg/mL. After 2, 6, and 24 hours, an aliquot was taken, formic acid was added to a final concentration of 2% and the samples were frozen. Samples were then thawed, spun and filtered. Samples were analyzed for monatin using the LC/MS/MS methodology described in Example 3. Additional aliquots were taken for stereoisomeric distribution analysis and were not treated with formic acid. The results for the 24 hour time point are shown in Table 24. The DAT nucleic acid encoding the DAT polypeptide having the sequence shown in SEQ ID NO:908 was not subcloned and could not be assayed.

TABLE 24

| Polypeptide (SEQ ID NO:) | monatin 2 hrs (ppm) | monatin 6 hrs (ppm) | monatin 24 hrs (ppm) | 24 hr % R,R |
|---|---|---|---|---|
| B. sphaericus | 261 | 1203 | 2604 | 95.6 |
| 870 | 193 | 1067 | 2490 | 96.8 |
| 870 T242N | 813 | 2230 | 3380 | 98.8 |
| 896 | 30 | 127 | 286 | 99.8 |
| 898 | nd | 3 | 15 | 95.7 |
| 900 | 4 | 16 | 56 | 92.9 |
| 902 | 144 | 411 | 1209 | 96.7 |
| 904 | nd | 1 | 4 | 92.3 |
| 906 | 14 | 18 | 25 | 98 |
| 910 | 487 | 1154 | 2770 | 94.5 | nd = not detectable under conditions tested

DAT polypeptides having the sequence shown in SEQ ID NO:910 and 902 had high levels of activity for the monatin formation reactions, and produced fairly high levels of R,R monatin. Results indicated that the DAT polypeptide having the sequence shown in SEQ ID NO:870 exhibited comparable activity to that of the wildtype polypeptide having the sequence shown in SEQ ID NO:910 under the conditions tested; however, the T242N mutation in the SEQ ID NO:870 polypeptide makes a large improvement in activity and stereospecificity of the enzyme.

Example 13

Analysis of DATs

Plasmids (pSE420-cHis) containing the nucleic acid sequences encoding SEQ ID NO:912, 914, 916, 918, 920, 922, 924, and 926 DATs were obtained. One skilled in the art could clone the genes using any number of gene assembly protocols such as the one described in Example 4.

E. coli Top10 (Invitrogen) cells were transformed with the pSE420-cHis plasmids containing DAT polypeptides having the sequence of SEQ ID NO:912, 914, 916, 918, 920, 922, 924, and 926 and plated on LB medium containing ampicillin (100 µg/mL). Five hundred µl of the overnight culture was used to inoculate 50 mL of the same medium into 250 mL baffled flasks. Cultures were grown at 30° C. to an $OD_{600nm}$ of approximately 0.4. IPTG was added to a final concentration of 1 mM. Cells were grown at 30° C. for 4 hours and collected by centrifugation.

Cell extracts were prepared as described in Example 4. Total soluble protein and DAT protein concentrations were determined as described in Example 4. Most of the DAT polypeptides that were expressed were soluble except for the SEQ ID NO:916 polypeptide, which was only partially soluble.

An R,R monatin formation assay was performed as described in Example 5, with a DAT polypeptide concentration targeted to about 0.25 mg/mL; except that 0.1 mg/mL of the SEQ ID NO:922 polypeptide was used and 0.2 mg/mL of the SEQ ID NO:926 polypeptide was used. As a positive control, purified B. sphaericus DAT was tested at a 0.25 mg/mL concentration. After 2, 8 and 24 hours, an aliquot was taken and formic acid was added to a final concentration of 2%, and the samples were frozen. Samples were then thawed, spun and filtered. Samples were analyzed for monatin using the LC/MS/MS methodology described in Example 3. The results are shown in Table 25.

TABLE 25

| Polypeptides (SEQ ID NO:) | monatin (ppm) 2 hours | monatin (ppm) 8 hours | monatin (ppm) 24 hours |
|---|---|---|---|
| B. sphaericus | 179 | 774 | 1482 |
| 912 | 0.2 | 2 | 2 |
| 914 | 4 | 22 | 62 |
| 916 | 0.6 | 2 | 6 |
| 918 | 158.8 | 402 | 496 |
| 920 | 5 | 40 | 96 |
| 922 | 0.2 | 2 | 2 |
| 924 | nd | nd | nd |
| 926 | 1.2 | 12 | 30 | nd = not detected under conditions assayed

DAT nucleic acids having the sequence shown in SEQ ID NO:169, 171, 167, 173 and 175 (encoding DAT polypeptides having the sequence shown in SEQ ID NO:170, 172, 168, 174 and 176) were obtained as PCR products and were subcloned in pET30a as described in Example 4. One of ordinary skill in the art could reconstruct the genes using any number of gene assembly methods such as the one described in Example 4.

E. coli BL21 DE3 cells containing DAT nucleic acids having the sequence of SEQ ID NO:169, 171, 167, 173 and 175 in the pET30a vector were grown in 50 mL of Overnight Express (Novagen) in a 250 mL baffled flask, overnight at 30° C. and 250 rpm. The cells were collected by centrifugation when the optical density at 600 nm was greater than 10.

Cell extracts were prepared as described in the Example 4. Total soluble protein and DAT protein concentrations were determined as described in Example 4. The polypeptide having the sequence of SEQ ID NO:170 (encoded by the DAT nucleic acid having the sequence of SEQ ID NO:169) did not appear to be soluble, which may have impeded activity assays.

An R,R monatin formation assay was performed as described in Example 5 using a DAT polypeptide concentration of 0.5 mg/mL, except that 0.25 mg/mL of the SEQ ID NO:170 polypeptide was used. As a positive control, purified B. sphaericus DAT was tested at a 0.5 mg/mL concentration. After 2, 8 and 24 hours, an aliquot was taken, formic acid was added to a final concentration of 2%, and the samples were frozen. Samples were then thawed, spun and filtered, and analyzed for monatin using the LC/MS/MS methodology described in Example 3. Results are shown in Table 26.

TABLE 26

| Polypeptides (SEQ ID NO:) | monatin (ppm) 2 hr | monatin (ppm) 8 hr | monatin (ppm) 24 hr |
|---|---|---|---|
| B. sphaericus | 456 | 1502 | 2970 |
| 170 | 2 | 8 | 14 |
| 172 | 5 | 20 | 60 |
| 168 | 15 | 68 | 186 |
| 174 | 1 | 4 | 8 |
| 176 | 451 | 1508 | 2744 |

Samples (without pH adjustment) were analyzed to determine % R,R using the FDAA derivatization protocol described in Example 3. The monatin produced by DAT polypeptide having the sequence shown in SEQ ID NO:176 was 99.6% R,R after 24 hrs compared to that produced by B. sphaericus, which was 95.2% R,R at the same timepoint. The activity and stereopurity resulting from the DAT polypeptide having the sequence of SEQ ID NO:176 were both quite high, and the corresponding nucleic acid was subcloned as a C-terminal tagged protein as described in Example 4 for more quantitative studies.

Characterization of SEQ ID NO:176 C-His-Tagged Protein

The nucleic acid having SEQ ID NO:175, which encodes the polypeptide having the sequence of SEQ ID NO:176, was cloned into pET30a without a stop codon so that it could be expressed as a fusion protein with a 6×His-tag on the C-terminus. The protein was purified using the His-bind resin described in Example 4. When the fusion protein was eluted from the PD-10 desalting column, a yellow precipitate formed in the solution. A yellow residue was also observed on the column. The yellow color usually is indicative of the presence of a PLP-binding protein. In an effort to prevent the precipitation of the PLP-binding protein at the desalting step, different buffers (100 mM phosphate and 100 mM EPPS with or without 10% glycerol) at two pH values (7.8 and 8.2) were utilized. None of the buffers tried appeared to completely prevent the precipitation.

The monatin assay was performed using a well-mixed heterogeneous protein solution and a DAT polypeptide concentration of 0.5 mg/mL. The results are shown in Table 27. The purified SEQ ID NO:176 DAT polypeptide (C-tagged) showed comparable activity to the positive control DAT polypeptide from B. sphaericus; however, the activity appeared to be lower than the activity exhibited by the mutant polypeptides having the sequence of SEQ ID NO:870 T242N or SEQ ID NO:870 T242N.

TABLE 27

| Polypeptide (SEQ ID NO:) | Monatin Production (ppm) | | | |
|---|---|---|---|---|
| | 2 hr | 4 hr | 8 hr | 24 hr |
| B. sphaericus | 262 | 676 | 1044 | 2150 |
| 870 | 332 | 678 | 1346 | 2826 |
| 870 T242N | 942 | 1938 | 2834 | 4004 |
| 176 | 208 | 392 | 732 | 1806 |

Example 14

Evaluation of DATs

The open reading frames encoding 29 DATs were obtained as PCR products. It is noted that one of ordinary skill in the art can synthesize the genes encoding the DATs using assembly techniques such as those described in Example 4. The DAT nucleic acids were subcloned into the pET30a vector and expressed as untagged proteins as described in Example 4. The desalted cell-free extracts (prepared as described in Example 4) were used in monatin formation assays. A DAT polypeptide concentration of 0.5 mg/mL was used for the monatin assay except for the following polypeptides (amounts used in parentheses): the SEQ ID NO:156 polypeptide (0.4 mg/mL), the SEQ ID NO:182 polypeptide (0.45 mg/mL), the SEQ ID NO:240 polypeptide (0.47 mg/mL), and the SEQ ID NO:204 polypeptide (0.42 mg/mL).

Most of the DAT polypeptides showed undetectable to low monatin production under the conditions assayed as compared to positive control enzymes. Most of the expressed DAT polypeptides were soluble as determined by the Experion; however, the polypeptides having SEQ ID NO:204 and 240 were expressed at very low levels and may not have been very soluble. On the other hand, the polypeptide having SEQ ID NO:220 was predicted to be 68% of the total soluble protein as judged by the Experion software.

The monatin production results are shown in Table 28 and 29. At 24 h, the DAT polypeptide having SEQ ID NO:156 and 214 produced 40-50% of monatin as compared to the positive control enzyme, the DAT from B. sphaericus. The most active DAT polypeptide was the SEQ ID NO:220 polypeptide. Approximately 4 h after the reaction was started, the monatin concentration reached a maximum. It is expected that the mature protein of SEQ ID NO:156 (without the predicted leader sequence) is the active component of the DAT polypeptide and, therefore, the protein can be produced recombinantly with the leader sequence absent.

TABLE 28

| Polypeptide (SEQ ID NO:) | Monatin Formed (ppm) | | | |
|---|---|---|---|---|
| | 2 hr | 4 hr | 8 hr | 24 hr |
| 178 | 11 | 24 | 62 | 194 |
| 180 | nd | nd | nd | nd |
| 154 | 52 | 103 | 166 | 178 |
| 182 | nd | nd | nd | nd |
| 218 | 1.6 | 2.8 | 274 | 12 |
| 188 | 2.4 | 5.2 | 10 | 22 |
| 190 | 3.8 | 9.4 | 22 | 42 |
| 208 | 1 | 1.2 | nd | nd |
| 220 | 2418 | 3563 | 3812 | 3882 |
| 196 | 1 | 1.8 | nd | 8 |

TABLE 28-continued

Monatin Formed (ppm)

| Polypeptide (SEQ ID NO:) | 2 hr | 4 hr | 8 hr | 24 hr |
|---|---|---|---|---|
| 156 | 64.8 | 156 | 296 | 796 |
| B. sphaericus | 422 | 791 | 1302 | 2124 | nd = not detectable under conditions assayed

TABLE 29

Monatin Formed (ppm)

| Polypeptide (SEQ ID NO:) | 2 | 4 | 8 | 24 |
|---|---|---|---|---|
| 166 | nd | nd | 1 | nd |
| 216 | 69 | 91 | 109 | 134 |
| 200 | nd | nd | 1 | 1 |
| 198 | nd | nd | nd | nd |
| 210 | 1.6 | 3.8 | 6.2 | 15.2 |
| 202 | 3.4 | 6.2 | 12.2 | 29.8 |
| 222 | 3.6 | 7 | 12.8 | 25.8 |
| 236 | nd | nd | nd | nd |
| 204 | nd | nd | nd | 3.6 |
| 238 | 10.4 | 21.8 | 46.4 | 115.6 |
| 240 | 3 | 6 | 12.4 | 32.2 |
| 224 | 39.8 | 85 | 171.8 | 268.8 |
| 226 | 2.6 | 5.8 | 12.4 | 30.6 |
| 228 | 4.2 | 9.8 | 21.4 | 66.8 |
| 230 | 9.2 | 21.8 | 42.2 | 94.4 |
| 232 | 3.6 | 9.4 | 21.6 | 57 |
| 246 | nd | nd | nd | nd |
| 214 | 160 | 327 | 694 | 1346 |
| B. sphaericus | 393 | 986 | 1624 | 2597 | nd = not detectable under conditions assayed

The high activity of the SEQ ID NO:220 polypeptide was confirmed in another monatin formation assay where the SEQ ID NO:220 polypeptide was compared to the SEQ ID NO:870, 870 T242N, and B. sphaericus DAT polypeptides. A DAT polypeptide concentration of 0.1 mg/mL and 0.5 mg was used for each of the DAT polypeptides assayed. The results are shown in Table 30. Due to the high degree of activity of the DAT polypeptides assayed, the monatin samples had to be diluted 100-fold to be within the quantitative range of the instruments used (as opposed to a typical 10- or 20-fold dilution).

TABLE 30

Monatin Formed (ppm)

| DAT Polypeptide (SEQ ID NO:) | 2 hr | 4 hr | 8 hr | 24 hr |
|---|---|---|---|---|
| B. sphaericus (0.1 mg/mL) | 74 | 170 | 309 | 728 |
| B. sphaericus (0.5 mg/mL) | 510 | 921 | 1068 | 2704 |
| 870 (0.1 mg/mL) | 28 | 81 | 179 | 706 |
| 870 (0.5 mg/mL) | 399 | 847 | 1466 | 2916 |
| 870 T242N (0.1 mg/mL) | 93.2 | 245.8 | 582.4 | 1270 |
| 870 T242N (0.5 mg/mL) | 1158.8 | 2026 | 3202 | 4126 |
| 220 (0.1 mg/mL) | 965.8 | 1512 | 2330 | 3788 |
| 220 (0.5 mg/mL) | 2950 | 4302 | 4618 | 4488 |

The percentage of R,R formed by the DAT polypeptide having SEQ ID NO:220 in the above experiments was determined using the FDAA derivatization methodology described in Example 3. The DAT polypeptide having the sequence of SEQ ID NO:220 is highly stereospecific, producing 99.3% R,R monatin at 24 hours as compared to 92.9% R,R for B. sphaericus. In another assay, the SEQ ID NO:220 polypeptide produced 99.8% R,R-monatin.

The exemplary DAT polypeptide of this invention having the sequence of SEQ ID NO:220 is a novel protein that is 62% identical at the protein level to the C. beijerinckii DAT polypeptide shown in Example 9. The SEQ ID NO:220 polypeptide has 86%-90% primary sequence homology (sequence identity) to other highly active DAT polypeptides (e.g., those having the sequence shown in SEQ ID NO:892 and 894 (Example 8), 946 (Example 7) and 176 (Example 13)). These highly active and novel DAT polypeptides were uncharacterized prior to this work, and these enzymes exhibited higher activity and stereospecificity for R,R monatin production reactions than any of the published Bacillus-like D-aminotransferases. FIG. 7 shows an alignment of these related D-aminotransferases and the consensus sequence motifs they have in common are described below.

```
Consensus Sequence C
                                                          (SEQ ID NO: 1071)
M.*GYYNG.*P.*DR.*FGDG.*YDAT.*N.*FAL.*H.*RF.*NS.*LL.*I.*K.*YWQ.*RG.*

G.*R.*H.*F.*N.*I.*P.*KLI.*DTRF.*HCNIKTLNL.*P.*VIA.*Q.*E.*C.*E.*VFHRG.*V

TECAHSN.*I.*NLIL.*G.*HL.*P.*E.*F.*L.*ADE.*V.*SS.*DG.*GGK.*K.*Q.*T

Consensus Sequence D
                                                          (SEQ ID NO: 1072)
M.{3}GYYNG.{10}P.{2}DR.{3}FGDG.YDAT.{3}N.{3}FAL.{2}H.{2}RF.NS.{2}LL.I.

{9}K.{17}YWQ.{2}RG.G.R.H.F.{5,7}N.{2}I.{3}P.{10}KLI.{3}DTRF.HCNIKTLNL.

P.VIA.Q.{3}E.{2}C.E.VFHRG.{2}VTECAHSN.{2}I.{11}DNLIL.G.{4}HL.{9}P.{2}E.

{2}F.{4}L.{2}ADE.{2}V.SS.{10}DG.{3}GGK.{5}K.{2}Q.{10}T

Consensus Sequence E
                                                          (SEQ ID NO: 1073)
M.*[LV]GYYNG.*[LI].*[ML].*[VI]P.*DR.*[YF]FGDG.*YDAT.*N.*FAL[DE][ED]H

[IL][DE]RF.*NS.*LL.*I.*[KR].*[EQ][LMV]K[KE].*[MV].*[DE].*[VL]YWQ.*[TS]RG

[TS]G.*R[NS]H.*F.*N[LI].*I.*P.*[IVL].*[KE].*KLI[TS].*[ED]DTRF.*HCNIKTLNL[I

L]P[NS]VIA[SA]Q[RK].*E.*C.*E.*VFHRG[ED].*VTECAHSN[VI].*I[IL][KR][ND].*
```

[TS].*DNLIL.*G.*HL[LI][QK].*[IV]P.*E.*F[TS][LM].*[ED]L.*ADE[VI][LI]V[ST]SS.

*[LMI].*[IL]DG.*GGK.*[LVI]K.*[IL]Q.*[EK][FY].*T

Similar to PERL regular expression convention language (perldoc.perl.org), ".*" indicates that any number of amino acid residues may be present from any of the 20 proteinogenic amino acids; [ ] indicates that any one of the amino acids in the brackets can be present; ".{#}" indicates that any of the 20 proteinogenic amino acids can be present as long as the number of residues matches the number (#) indicated in the brackets.

With respect to the use of ".*" in Consensus sequence C, the number of amino acids at any of the ".*" positions can vary, for example, from about 0 to about 20 residues (see, for example, Consensus sequences D (SEQ ID NO:1072) and E (SEQ ID NO:1073)) or from about 20 residues up to about 100 residues, or the number of amino acids can be much larger, for example, up to 1000 or more residues. Without limitation, an insertion at one or more of the ".*" positions can correspond to, for example, a domain such as (but not limited to) a chitinase binding domain (e.g., from *Pyrococcus furiosus* (Accession No. 2CZN_A) or *P. burkholderia* (Accession No. YP_331531) or a cellulose binding domain (e.g., from *Cellulomonas fimi* (Accession No. 1EXH_A) or *Clostridium stercorarium* (Accession No. 1UY1_A). In some embodiments (without limitation), five or less of the positions designated ".*" each contain an insertion of, for example, greater than about 20 residues (e.g., greater than about 100 residues). In other embodiments (without limitation), five or more of the positions designated ".*" each contains an insertion of less than about 100 residues (e.g., less than about 20 residues, e.g., 3, 5, 10, 20, 25, 30, 40, 50, 60, 70, 75, 80, 90, or 95 residues). The activity of a polypeptide having a sequence that corresponds to one or more of the consensus sequences disclosed herein and containing any number of residues inserted at one or more of the ".*" positions can be evaluated using methods that are described herein.

Non-limiting representative polypeptides that contain the consensus sequence shown in SEQ ID NO:1071 include SEQ ID NO:220, 892, 894, 176 and 946 and Consensus sequences D (SEQ ID NO:1072) and E (SEQ ID NO:1073)). It is expected that any D-aminotransferase exhibiting any of consensus sequences C, D, or E would be active in monatin formation pathway steps.

Characterization of a C-His-Tagged Polypeptide Having the Sequence of SEQ ID NO:220

The DAT nucleic acid having the sequence of SEQ ID NO:219 (encoding the polypeptide of SEQ ID NO:220) was cloned into pET30a without a stop codon such that it was expressed as a fusion protein with a 6xHis-tag on the C-terminus (as described in Example 4). The fusion protein was purified using the His-Bind column (Novagen) described in Example 4. The eluate from the PD-10 desalting column formed a yellow precipitate. Yellow residue was also observed on the column. Monatin assays were done using a well-mixed heterogenous protein solution. Amounts of DAT polypeptide used are indicated in parentheses in the far left column. The notation w/Trp indicates that the enzyme was incubated with 10 mM D-tryptophan overnight on ice.

Results are shown in Table 31.

TABLE 31

| Polypeptide (SEQ ID NO:) | Monatin formed (ppm) | | | |
|---|---|---|---|---|
| | 2 hr | 4 hr | 8 hr | 24 hr |
| *B. sphaericus* (0.5 mg/mL) | 382 | 660 | 1021 | 1986 |
| 870 T242N (0.1 mg/mL) | 69 | 205 | 412 | 1074 |
| 870 T242N w/Trp (0.1 mg/mL) | 63 | 163 | 383 | 978 |
| 870 T242N (0.5 mg/mL) | 919 | 1698 | 2356 | 3130 |
| 870 T242N w/Trp (0.5 mg/mL) | 772 | 1519 | 2294 | 3023 |
| 220 (0.1 mg/mL) | 847 | 1462 | 2202 | 3004 |
| 220 (0.1 mg/mL) | 811 | 1522 | 2202 | 2887 |
| 220 w/Trp (0.1 mg/mL) | 537 | 1080 | 1590 | 2401 |
| 220 (0.5 mg/mL) | 2885 | 3446 | 3813 | 4066 |
| 220 w/Trp (0.5 mg/mL) | 1933 | 3223 | 3939 | 3911 |

The reaction containing 0.1 mg/mL of the SEQ ID NO:220 polypeptide showed a similar monatin formation time course as the reaction containing 0.5 mg/mL of the SEQ ID NO:870 T242N polypeptide. Addition of D-tryptophan (10 mM) to the solution containing the purified protein eliminated the precipitation. Activity loss was observed for the sample in which SEQ ID NO:220 was incubated with D-tryptophan (10 mM) overnight on ice, but no negative effect was observed when the SEQ ID NO:870 T242N polypeptide was treated with D-tryptophan (10 mM). The presence of HMG was also analyzed qualitatively for reactions catalyzed by the SEQ ID NO:220 polypeptide by comparing peak areas. When both DAT polypeptides were utilized at a concentration of 0.5 mg/mL, the reaction catalyzed by the SEQ ID NO:220 polypeptide formed around 40% of the HMG compared to the reaction containing the SEQ ID NO:870 T242N polypeptide. Earlier time points show an even more pronounced difference between the two enzymes.

In an attempt to prevent the protein precipitation during the purification of the SEQ ID NO:220 polypeptide, DTT (5 mM) was included in all the buffers including the Bugbuster reagent, the buffers for His-Bind column and the buffer for PD-10 column. No precipitation was observed after the desalting column, and no negative effect was observed on the activity of the SEQ ID NO:220 polypeptide when DTT was included during purification or added into purified protein solution at a concentration of 2 mM. Data for monatin formation assays are shown in Table 32. The amount of DAT polypeptide used is indicated in the left column in parentheses. "added DTT" indicates that 2 mM DTT was added to resolubilize the protein after purification; and "purified w/DTT" indicates that 5 mM DTT was present throughout the purification.

TABLE 32

| Polypeptide (SEQ ID NO:) | Monatin Formed (ppm) | | |
|---|---|---|---|
| | 2 hr | 4 hr | 24 hr |
| *B. sphaericus* (0.5 mg/mL) | 426 | 965 | 2638 |
| 870 T242N (0.5 mg/mL) | 977 | 1916 | 4227 |
| 220 (0.1 mg/mL) | 1214 | 2163 | 3964 |
| 220 (0.5 mg/mL) | 3534 | 4246 | 4415 |
| 220 added DTT (0.1 mg/mL) | 1287 | 2202 | 3566 |
| 220 added DTT (0.4 mg/mL) | 3495 | 4833 | 5082 |

TABLE 32-continued

Monatin Formed (ppm)

| Polypeptide (SEQ ID NO:) | 2 hr | 4 hr | 24 hr |
|---|---|---|---|
| 220 purified w/DTT (0.1 mg/mL) | 1204 | 2169 | 3997 |
| 220 purified w/DTT (0.5 mg/mL) | 3562 | 4110 | 4353 |

The highly desirable properties of the SEQ ID NO:220 polypeptide make it an excellent candidate for further mutagenesis or directed evolution experiments.

Site-Directed Mutagenesis of the SEQ ID NO:220 Polypeptide

A loop region of the DAT polypeptide related to the *Bacillus* DAT polypeptide was identified as being important for the substrate specificity and stereospecificity of the enzymes (Ro et al., 1996, *FEBS Lett*, 398:141-145; Sugio et al., 1995, *Biochemistry* 34:9661-9669; and EP 1 580 268). One key residue in this region is a T at residue 242 (in the DAT polypeptide from ATCC #4978, this position corresponds to a T at residue 243). A T242N mutant of the SEQ ID NO:870 polypeptide showed improvement in both activity and stereospecificity, as did the T243N mutant of DAT 4978 (see Example 10). Primary sequence alignment of the SEQ ID NO:220 polypeptide with the SEQ ID NO:870 polypeptide showed only 35% amino acid sequence identity and 65% homology. The T242 residue in SEQ ID NO:870 aligned with a G240 residue in SEQ ID NO:220, which is followed by a T241 residue. Using Accelrys DS Modeler software for both proteins (with *Bacillus* YM-1 structures as templates), it was difficult to overlap the loop region of the SEQ ID NO:870 polypeptide with the SEQ ID NO:220 polypeptide. Therefore, both amino acids were chosen as targets for site-directed mutagenesis.

A mutant polypeptide designated SEQ ID NO:220 G240N and SEQ ID NO:220 T241N were generated by site-directed mutagenesis of the corresponding nucleic acid (SEQ ID NO:219) as described in Example 4. The two mutant polypeptides were expressed and purified as 6×His-tagged fusion proteins that were used in the monatin formation assay. Yellow precipitation was observed at the desalting step for both of the mutant SEQ ID NO:220 polypeptides. Results are shown in Tables 33 and 34 for monatin formation assays. The amount of D-aminotransferase used is indicated in the left-hand column in parentheses. Different preparations of the SEQ ID NO:220 polypeptide were utilized in the assay. "ferm" indicates that the SEQ ID NO:220 polypeptide used was produced in a fermentor as described in Example 15.

TABLE 33

Monatin Produced (ppm)

| Polypeptide (SEQ ID NO:) | 2 hrs | 4 hrs | 8 hrs | 24 hrs |
|---|---|---|---|---|
| B. sphaericus (0.5 mg/mL) | 440 | 777 | 1510 | 2621 |
| 870 T242N (0.5 mg/mL) | 961 | 1913 | 2793 | 3904 |
| ferm 220 (0.1 mg/mL) | 1396 | 2379 | 3217 | 3770 |
| ferm 220 (0.2 mg/mL) | 2301 | 3277 | 3789 | 4328 |
| ferm 220 w/DTT (0.1 mg/mL) | 1434 | 2384 | 3109 | 3730 |
| ferm 220 w/DTT (0.2 mg/mL) | 2423 | 3568 | 3859 | 4755 |
| 220 (0.1 mg/mL) | 1109 | 1912 | 2809 | 3713 |
| 220 T241N (0.1 mg/mL) | 554 | 856 | 1084 | 1986 |

TABLE 34

Monatin Formed (ppm)

| Polypeptide (SEQ ID NO:) | 2 hr | 4 hr | 8 hr | 24 hr |
|---|---|---|---|---|
| B. sphaericus (0.5 mg/mL) | 634 | 938 | 1651 | 2754 |
| 870 T242N (0.5 mg/mL) | 1422 | 1922 | 3211 | 3793 |
| ferm 220 (0.1 mg/mL) | 1976 | 2505 | 3442 | 4211 |
| ferm 220 (0.2 mg/mL) | 3198 | 3430 | 4452 | 4639 |
| 220 G240N (0.1 mg/mL) | 3 | 5 | 14 | 42 |
| 220 G240N (0.2 mg/mL) | 9 | 17 | 46 | 94 |

A very small amount of monatin (95.7% R,R monatin) was formed in the reaction catalyzed by the mutant SEQ ID NO:220 G240N polypeptide. The mutant SEQ ID NO:220 T241N polypeptide lost about 50% of the activity, but still maintained the stereospecificity (99.7% R,R monatin produced). These results, together with the homology (sequence identity) modeling and alignments, suggest that, in the region surrounding residues 242-243 (and potentially beyond), the structure of the SEQ ID NO:220 polypeptide is not similar to the structure of the SEQ ID NO:870 polypeptide or the structure of the *Bacillus*-like DAT polypeptide in the literature. Since there is no x-ray crystal structure, random mutagenesis, combinatorial approaches and other directed evolution approaches of the SEQ ID NO:220 polypeptide and related DAT polypeptides are expected to be highly productive in further improving the enzyme's activity.

Example 15

Production of a DAT in a Fermentor

Bacterial growth media components were from Difco, Fisher Scientific, or VWR; other reagents were of analytical grade or the highest grade commercially available. The fermentation was run in a New Brunswick Scientific (Edison, N.J.) BioFlo 3000® fermenter. Centrifugation was carried out using a Beckman (Fullerton, Calif.) Avanti® J-25I centrifuge with a JLA-16.250 or JA-25.50 rotor.

The DAT nucleic acid encoding the polypeptide having the sequence in SEQ ID NO:220 with a C-terminal His-tag was cloned using Nde I/Xho I restriction sites into the PMet1a vector described in Example 16. The antibiotic marker (bla gene) can further be removed using Psi I restriction enzyme digestion, gel purification of the vector band, self-ligation of the vector ends, transformation into the *E. coli* host, and selection on minimal medium plates that do not contain methionine. Typically, Neidhardt's medium with 15 amino acids is used. The cloning sites were NdeI/XhoI to insert the SEQ ID NO:220 nucleic acid sequence into pMET1a (see Example 16).

The SEQ ID NO:220 DAT polypeptide carrying a C-terminal His-purification tag was produced in a fermentor at the 2.5-L scale, in a fed-batch process that achieves high cell densities and high levels of expression of the desired protein. The protocol and results for growth of *E. coli* strain B834 (DE3)::SEQ ID NO:220cHIS pMET1 are described as follows: Starting from a fresh culture plate (Neidhardt's+15 amino acids, no methionine), the cells were grown in 5 mL of Neidhardt's medium supplemented with 15 amino acids, at 30° C. and 225 rpm for 6-8 h. One mL of the culture was transferred to each of 2 125-mL aliquots of the production medium supplemented with 5 g/L of glucose. The flasks were grown at 30° C. and 225 rpm overnight (16-18 h). A fermentor was charged with 2.5 liters of the production medium, containing (per liter): 2.0 g/L $(NH_4)_2SO_4$; 8.0 g/L $K_2HPO_4$; 2.0 g/L NaCl; 1.0 g/L Na$_3$Citrate.2H$_2$O; 1.0 g/L MgSO$_4$.7H$_2$O; 0.025 g/L CaCl$_2$.2H$_2$O; 0.05 g/L FeSO$_4$.7H$_2$O; 0.4 mL/L Neidhardt micronutrients, and 2.0 g/L glucose. The fermenter was inoculated with 10% v/v of the overnight culture. Three hours after inoculation, an exponential glucose feed was set up using a 60% w/v glucose solution. The feed was supplied at the required rate to support microbial growth at an exponential rate of 0.15 h$^{-1}$. When the carbon dioxide evolution rate (CER) had reached a value of 100 mmoles/L/h (approximately 21 hours after inoculation; corresponding to a cell biomass of 15-16 g DCW/L), gene expression was induced with a bolus addition of 2 g/L lactose (fed as a 20% solution). The feed was changed from 60% w/v glucose to 50% w/v glucose+10% w/v lactose while the feed rate was fixed to the rate at time of induction. The "50% w/v glucose+10% w/v lactose" feed was maintained for 6 hours. At the end of the fermentation, the cells were harvested by centrifugation at 5000-7000×g for 10 min and frozen as a wet cell paste at −80° C. Cell paste (318 grams) was harvested from 2.8 L of cell broth.

To prepare cell free extract containing the SEQ ID NO:220 polypeptide, 50 g of wet cell paste was suspended in 150 mL of 50 mM EPPS buffer (pH 8.4) containing 50 pyridoxal phosphate (PLP) and then disrupted using a Microfluidics homogenizer (Microfluidics, Newton, Mass.) (3 passes at 18,000 psi), maintaining the temperature of the suspension at less than 15° C. The cell debris was removed by centrifugation (20,000×g for 30 minutes). Two mM DTT was added to the clarified cell extract.

To prepare purified SEQ ID NO:220, 2×25 mL aliquots of clarified cell extract were loaded each onto a 45 mL Chelating Sepharose™ Fast Flow resin (nickel(II) form) column that had been previously equilibrated with 50 mM EPPS (pH 8.4) containing 0.05 mM PLP and 200 mM sodium chloride. After loading the sample, the column was washed/eluted successively with 3-5 volumes of the equilibration buffer, 3-5 volumes of the equilibration buffer containing 25 mM imidazole, 3-5 volumes of the equilibration buffer containing 100 mM imidazole and 3-5 volumes of the equilibration buffer containing 500 mM imidazole. The 500 mM imidazole eluent was concentrated 10× with an Amicon (Billerica, Mass.) Centricon-70 centrifugal filter device (MWCO 10 kDa). The imidazole and sodium chloride were removed by passage through disposable GE Healthcare PD10 desalting columns previously equilibrated with 50 mM EPPS (pH 8.4) containing 0.05 mM PLP. The protein concentration of the desalted solution was determined using the Pierce BCA assay kit (Rockford, Ill.). The purity of each fraction and the level of expression in the cell free extract fraction were determined by SDS-PAGE with 4-15% gradient gels. Approximately 450 mg of protein that was ~90% pure was recovered from the 50 mL of clarified cell extract. Two mM DTT was added to 10 mL of the purified protein. The purified protein was dispensed into aliquots (0.5-5 mL) and stored at −80° C.

Bench scale reactions (250 mL) were carried out in 0.7 L Sixfors agitated fermenters (Infors AG, Bottmingen, Switzerland) under a nitrogen headspace. The reaction mix contained 10 mM potassium phosphate, 1 mM MgCl$_2$, 0.05 mM PLP, 200 mM sodium pyruvate and 100 mM D-tryptophan. The reaction mix was adjusted to the appropriate temperature, and adjusted to the appropriate pH with potassium hydroxide. The aldolase described in Example 6 was added as a clarified cell extract at 0.02 mg/mL of target protein. The SEQ ID NO:220 DAT polypeptide was added (either as purified enzyme or as a clarified cell extract) at 0.25 mg/mL of target protein.

The progress of the reactions was followed by measuring monatin concentration using the LC/MS/MS methodology described in Example 3.

Starting with D-tryptophan and under the conditions tested, the pH optimum of the monatin formation reactions using the SEQ ID NO:220 polypeptide was found to be approximately pH 8.0 and the temperature optimum of the monatin formation reactions utilizing the SEQ ID NO:220 polypeptide was found to be approximately 25° C. These reactions have complex dynamics and the optimum reaction conditions for the full monatin production reaction may not be the same as the optimal conditions for individual reactions catalyzed by the DAT polypeptide.

Example 16

The Co-Expression of Chaperones to Increase the Soluble Expression of a DAT Polypeptide Because the soluble expression of the SEQ ID NO:894 DAT polypeptide was low using the standard expression protocols (either 1 mM IPTG in LB or Novagen Overnight Express Autoinduction System 2, see Example 8), co-expression of the SEQ ID NO:894 polypeptide and a variety of commercially available chaperones was examined.

Chaperones:

The TaKaRa Chaperone Set (TAKARA BIO catalog #3340) consists of five different sets of chaperones developed by HSP Research Institute, Inc. They are designed to enable efficient expression of multiple molecular chaperones known to work in cooperation in the folding process. The set contained the following:

| Plasmid | Chaperone | Promoter | Inducer | Resistance Marker |
|---------|-----------|----------|---------|-------------------|
| pG-KJE8 | dnaK-dnaJ-grpE; groES-groEL | araB; Pzt1 | L-Arabinose; tetracycline | chloramphenicol |
| pGro7 | groES-groEL | araB | L-Arabinose | chloramphenicol |
| pKJE7 | dnaK-dnaJ-grpE | araB | L-Arabinose | chloramphenicol |
| pG-Tf2 | groES-groEL-tig | Pzt1 | Tetracycline | chloramphenicol |
| pTf16 | tig | araB | L-Arabinose | chloramphenicol |

Transformation Protocol

Chemically competent BL21 (DE3) cells (EMD Biosciences/Novagen catalog #69450) were transformed with 20 ng of one of the TaKaRa chaperone plasmids and 20 ng of SEQ ID NO:893/pET30a (encoding the SEQ ID NO:894 polypeptide; see Example C2 for the plasmid construction) by heat shock for 30 seconds at 42° C. The transformed cells were recovered in 0.5 mL of SOC medium for 1 hr at 37° C. and plated on LB plates containing 50 mg/L kanamycin and 25 mg/L chloramphenicol. The plates were incubated overnight at 37° C. Colonies were picked from the overnight plates and used to inoculate 5 mL of 2×YT medium containing 50 mg/L kanamycin and 25 mg/L chloramphenicol. After overnight incubation at 37° C., the plasmids were isolated from the cell pellets using a QUIAprep Spin Miniprep Kit (Qiagen catalog #27104). The plasmids were analyzed by restriction digestion with one-cutter enzymes from New England Biolabs (Beverly, Mass.) for both the chaperone plasmid and the SEQ ID NO:893/pET30a plasmid following the manufacturer's recommended protocol.

| Plasmid | Restriction Enzyme |
|---|---|
| pG-KJE8 | XhoI |
| pGro7 | XbaI |
| pKJE7 | NheI |
| pG-Tf2 | XhoI |
| pTf16 | XbaI |

The isolated DNA containing both SEQ ID NO:893/pET30a and pKJE7 was digested with NheI and XbaI.

Expression Studies

Flasks of Novagen Overnight Express™ Autoinduction-System 2 (EMD Biosciences/Novagen catalog #71366) containing solutions 1-6, 50 mg/L kanamycin and 25 mg/L chloramphenicol (25 mL in each flask) were inoculated from fresh plates of the cells co-transformed with a chaperone plasmid and SEQ ID NO:893/pET30. At inoculation the inducers required for the chaperone plasmids were also added.

| Plasmid | Inducer concentration |
|---|---|
| pG-KJE8 | 2 mg/mL L-arabinose; 10 ng/mL tetracycline |
| pGro7 | 2 mg/mL L-arabinose |
| pKJE7 | 2 mg/mL L-arabinose |
| pG-Tf2 | 10 ng/mL tetracycline |
| pTf16 | 2 mg/mL L-arabinose |

The cells were incubated at 30° C. overnight and harvested by centrifugation when the OD at 600 nm reached 6 or greater. The cells were washed with cold 50 mM EPPS buffer (pH 8.4), centrifuged again, and either used immediately or frozen at −80° C.

Cell extracts were prepared by adding 5 mL per g of cell pellet of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/mL of Benzonase® Nuclease (EMD Biosciences/Novagen catalog #70746), and 0.033 μl/mL of r-Lysozyme solution (EMD Biosciences/Novagen catalog #71110) to the cells. The cell suspensions were incubated at room temperature with gentle mixing for 15 min; spun at 14,000 rpm for 20 min (4° C.) and the supernatants carefully removed. Total protein concentrations were determined using the Pierce BCA protein assay kit (Pierce catalog #23225) with bovine serum albumin as the standard and a microtiter plate format. The expression of the D-aminotransferase was analyzed by SDS-PAGE using Bio-Rad Ready Gel® Precast 4-15% polyacrylamide gradient gels (Bio-Rad Laboratories catalog #161-1104). BioRad SDS-PAGE low range standards (catalog #161-0304) were run as standards on each gel. Aliquots of the cell extracts (15 μg protein) were mixed with protein loading buffer containing 2% SDS, 10% glycerol, 12.5% 2-mercaptoethanol, 0.1% bromophenol blue and 62.5 mM Tris-HCl (pH 8), incubated at 95° C. for 5 min, cooled and then loaded on the gel. In addition, the combined soluble and insoluble protein expression (total protein) was analyzed for each transformant. A 10 μl aliquot of each cell suspension before centrifugation was diluted in 90 μL protein loading buffer, incubated at 95° C. for 10 min, and cooled. Ten μL of each cooled solution was loaded on the gel.

The soluble protein gel showed that the best soluble expression of the polypeptide having the sequence of SEQ ID NO:894 occurred when chaperones GroEL-GroES (pGro7) were co-expressed.

The expression of the SEQ ID NO:894 polypeptide using an alternative plasmid in the presence of the GroEL-GroES chaperones was also examined. The SEQ ID NO:893 nucleic acid was subcloned into the pMET1a plasmid using the restriction enzymes NdeI and XhoI from New England Biolabs. This plasmid is a derivative of pET23a (EMD Biosciences/Novagen catalog #69745-3) and carries the metE gene (inserted at the NgoMIV site of the plasmid) and can complement the methionine auxotrophy of E. coli strains B834 (DE3) and E. coli BW30384(DE3) ompTmetE ("EE2D"). The construction of the "EE2D" strain is described in WO 2006/066072. The construction of an analogous plasmid to pMET1a that is a derivative of pET23d is described in the same PCT application.

The SEQ ID NO:893/pMET1a plasmid (25 ng) was transformed into "EE2D" electrocompetent cells singly or was co-transformed with pGro7 (20 ng) using the standard Bio-Rad electroporation protocol for E. coli cells with a Bio-Rad Gene Pulser II system (catalog #165-2111). The transformed cells were recovered in 0.5 mL of SOC medium for 1 h at 37° C. and plated on LB plates containing 100 mg/L ampicillin or on plates containing 100 mg/L ampicillin and 25 mg/L chloramphenicol (double plasmid transformants). The plates were incubated overnight at 37° C. One colony from each plate set was used to inoculate 50 mL of Novagen Overnight Express™ AutoinductionSystem 2 containing solutions 1-6, 100 mg/L ampicillin and 2 mg/mL L-arabinose. The culture inoculated with cells containing the pGro7 plasmid also contained 25 mg/L chloramphenicol. The cells were incubated at 30° C. overnight and harvested by centrifugation when the $OD_{600}$ reached 6 or greater. The cell pellets were washed with cold 50 mM EPPS buffer (pH 8.4), centrifuged again, and either used immediately or frozen at −80° C. Cell extracts were prepared as described above using the Novagen BugBuster® (primary amine-free) Extraction Reagent. The expression of soluble and total D-aminotransferase was analyzed by SDS-PAGE as described above.

The gel showed that expression of soluble SEQ ID NO:894 polypeptide was greater when the GroEL-GroES proteins were co-expressed. However, the soluble expression was not as high as with the pET30a construct described above.

The effect of incubation temperature during expression was also examined. A 5 mL culture of LB containing 100 mg/L ampicillin and 25 mg/L chloramphenicol was inoculated from a fresh plate of EE2D::SEQ ID NO:894PMET1a+pGro7. The culture was incubated overnight at 30° C. and then used to inoculate 3 flasks, each containing 50 mL of Novagen Overnight Express™ Autoinduction System 2 containing solutions 1-6, 100 mg/mL ampicillin, 25 mg/L chloramphenicol, and 2 mg/mL L-arabinose. One flask was incubated at 20° C., the second at 25° C. and the third at 30° C. The cells were harvested when the $0D_{600}$ reached 6 or greater. The cells were harvested and cell extracts were prepared as described above. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion Pro260 Automated Electrophoresis Station following the manufacturer's protocol with the cell extract solutions diluted to 1 mg/mL. The results are shown in Table 35. It appears that the lowest temperature gave the maximum amount of expression of the SEQ ID NO:894 polypeptide.

TABLE 35

| Lane | Sample | Temp | Estimated DAT Expression |
|---|---|---|---|
| 1 | Pro260 Ladder | | |
| 2 | EE2D::23463pMET1 + pGRO7 cell extract | 20° C. | 23% |
| 3 | EE2D::23463pMET1 + pGRO7 cell extract | 25° C. | 21% |
| 4 | EE2D::23463pMET1 + pGRO7 cell extract | 30° C. | 19% |

Activity Assay Protocol

The enzymatic activity of the SEQ ID NO:894 DAT co-expressed with the GroEL-GroES chaperones was tested following the standard monatin reaction protocol. Briefly, each assay tube contained the following (in a total of 2 mL): 0.050 mg/mL aldolase in cell extract (assuming 20% soluble expression); 1.0 mg/mL D-aminotransferase in cell extract (assuming 20% soluble expression for an extract containing the SEQ ID NO:894 polypeptide) or purified *B. sphaericus* D-aminotransferase; 0.01% Tween-80; 200 mM sodium pyruvate; 100 mM D-tryptophan; 100 mM EPPS (pH 8.2); 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen. All components except the enzymes were mixed together (the tryptophan did not completely dissolve until at least 1 h after the addition of the enzymes). The reactions were initiated by the addition of the enzymes. Samples were withdrawn at 1, 4, 8 and 22 h. A control reaction using 1 mg/mL purified *B. sphaericus* DAT was also run. The construction, expression and purification of this DAT are described in Example 6. The concentrations of the substrates and products were measured as described in Example 3.

The results are shown in Table 36. At 22 h, the concentration of monatin was 9.2 mM when the SEQ ID NO:894 polypeptide was present and 12.4 mM when the *B. sphaericus* enzyme was used. The concentration of the co-product HMG was significantly less when the SEQ ID NO:894 polypeptide was in the assay mixture (<⅓ the concentration when compared to the assay sample containing *B. sphaericus* enzyme). The HMG concentrations were evaluated by comparing the peak areas of the OPA derivatized samples.

TABLE 36

| Polypeptide (SEQ ID NO:) | Monatin Formation (mM) | | | |
|---|---|---|---|---|
| | 1 h | 4 h | 8 h | 22 h |
| 894 DAT + GroEL-ES | 1.3 | 4.5 | 6.8 | 9.2 |
| *B. sphaericus* DAT | 1.6 | 5.7 | 8.3 | 12.4 |

Example 17

Use of ArcticExpress™ System to Increase Soluble DAT Polypeptide Expression

Because the soluble expression of the SEQ ID NO:894 polypeptide was low using the standard expression protocols (either 1 mM IPTG in LB or Novagen Overnight Express™ AutoinductionSystem 2—see Example 8), expression of the SEQ ID NO:893/pMET1a plasmid in the Stratagene ArcticExpress™ system was examined.

The Stratagene ArcticExpress™ system contains *E. coli* competent cells that carry the psychrophilic chaperones Cpn10 and Cpn60. These are chaperones isolated from the psychrophilic organism *Oleispira antarctica*. Cpn10 and Cpn60 show high sequence similarity to the *E. coli* chaperones GroEL and GroES, respectively, and have high protein folding activities at 4-12° C. The ArcticExpress™ host cells are derived from the *E. coli* BL21strain. Not only do these cells lack the Lon protease, but they have been engineered to be deficient in OmpT protease as well.

Transformation Protocol

The plasmid SEQ ID NO:893/pMET1a (described in Example 16) was transformed into chemically competent ArcticExpress™ (DE3) cells (catalog #230192) following the manufacturer's protocol. The transformed cells were recovered in 0.5 mL of SOC medium for 1 h at 37° C. and plated on LB plates containing 100 mg/L ampicillin. The plates were incubated overnight at 37° C. and then stored at 4° C.

Expression Protocol

Colonies from the transformation plates were used to inoculate 5 mL of 2×YT medium containing 100 mg/L ampicillin and 10 mg/L gentamycin and incubated overnight at 30° C. Flasks of Novagen Overnight Express™ AutoinductionSystem 2 (EMD Biosciences/Novagen catalog #71366) containing solutions 1-6, with 100 mg/L ampicillin and 12 mg/L gentamycin were inoculated using the overnight cultures. After incubation at 30° C. for 6 h and the Overnight Express™ cultures were moved to either 15° C. or 20° C. or 25° C. incubators. The incubations were continued until the OD at 600 nm of the cultures reached 6 or greater. The cells were harvested by centrifugation, washed with cold 50 mM EPPS, pH 8.4, and the cell pellets were frozen at −80° C.

Cell extracts were prepared by adding 5 mL per g of cell pellet of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/mL of Benzonase Nuclease (EMD Biosciences/Novagen catalog #70746), and 0.033 μl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion Pro260 Automated Electrophoresis Station following the manufacturer's protocol with the cell extracts solutions diluted to 1 mg/mL.

The electrophoresis results show that the ArcticExpress™ system significantly increased the soluble expression of the SEQ ID NO:894 polypeptide when compared to the expression without chaperones or when co-expressed with the *E. coli* GroEL-GroES chaperones described in Example 16. The soluble expression was higher at lower temperatures, but still very high at 25° C.

| Lane | Sample | Incubation Temperature | Estimated DAT Expression |
|---|---|---|---|
| 1 | Pro260 Ladder | | |
| 2 | ArcticExpress(DE3)::894pMET1 cell extract | 15° C. | 58% |
| 3 | ArcticExpress(DE3)::894pMET1 cell extract | 20° C. | 46% |

-continued

| Lane | Sample | Incubation Temperature | Estimated DAT Expression |
|---|---|---|---|
| 4 | ArcticExpress(DE3)::894pMET1 cell extract | 25° C. | 47% |

Activity Assay Protocol:

The enzymatic activity of the SEQ ID NO:894 polypeptide expressed in the ArcticExpress™ system was tested by following monatin formation in the presence of the aldolase described in Example 6. Each assay tube contained the following (in a total of 2 mL): 0.010 mg/mL aldolase in cell extract (assuming 20% soluble expression); 1.0 or 2.0 mg/mL of the SEQ ID NO:894 polypeptide in cell extract (assuming 50% soluble expression for the extract containing the SEQ ID NO:894 polypeptide) or purified B. sphaericus D-aminotransferase; 0.01% Tween-80; 200 mM sodium pyruvate; 100 mM D-tryptophan; 100 mM EPPS, pH 8.2; 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen. All components except the enzymes were mixed together (the tryptophan did not completely dissolve until at least 1 h after the addition of the enzymes). The reactions were initiated by the addition of the enzymes. Samples were withdrawn at 1, 4, 7 and 22 h. Control reactions using 1 or 2 mg/mL purified B. sphaericus D-aminotransferase were also run. The concentrations of the substrates and products were measured as described in Example 3. The results are shown in Table 37. At 22 h, the concentration of monatin was 8.2 mM when the SEQ ID NO:894 polypeptide was present at 1 mg/mL and 10.5 mM at 2 mg/mL DAT polypeptide. When the B. sphaericus enzyme was added at 1 mg/mL, the concentration of monatin at 22 h was 10.7 mg/mL; at 2 mg/mL, the monatin concentration was 14.5 mM. The stereopurity (as determined by the FDAA derivatization protocol in Example 3) of the product was >98% R,R with both enzymes and enzyme concentrations. The concentration of the co-product HMG was significantly less when the SEQ ID NO:894 polypeptide was used (~⅓ the concentration when compared to the assay samples containing B. sphaericus enzyme at either enzyme concentration). The HMG concentrations were evaluated by comparing the peak areas of the OPA derivatized samples.

TABLE 37

| Polypeptide (SEQ ID NO:) | Monatin Formation (mM) | | | |
|---|---|---|---|---|
| | 1 h | 4 h | 7 h | 22 h |
| 894 DAT (1 mg/mL) | 0.9 | 2.3 | 3.6 | 8.3 |
| 894 DAT (2 mg/mL) | 1.4 | 3.7 | 6.3 | 10.5 |
| B. sphaericus DAT (1 mg/1 mL) | 1.0 | 4.2 | 6.1 | 10.7 |
| B. sphaericus DAT (2 mg/1 mL) | 1.5 | 6.7 | 8.2 | 14.5 |

Example 18

Use of Stratagene ArcticExpress™ System to Increase Soluble DAT Expression

Transformation Protocol:

The plasmids SEQ ID NO:891/pET30a (encoding the SEQ ID NO:892 polypeptide), SEQ ID NO:873/pET30a (encoding the SEQ ID NO:874 polypeptide) and the Clostridium beijerinckii DAT (CbDAT) in pET30a were transformed into chemically competent Stratagene ArcticExpress™ (DE3) cells (catalog #230192) following the manufacturer's protocol. The cloning of these genes is described in Example 4 and assay results are in Example 9. The transformed cells were recovered in 0.5 mL of SOC medium for 1 h at 37° C. and plated on LB plates containing 100 mg/L ampicillin and 13 mg/L gentamycin. The plates were incubated at room temperature for 2 days and then stored at 4° C.

Expression Protocol:

Colonies from the transformation recovery plates were used to inoculate 5 mL of 2×YT medium containing 50 mg/L kanamycin and 13 mg/L gentamycin; the liquid cultures were incubated for 6 h at 30° C. Flasks of Novagen Overnight Express™ AutoinductionSystem 2 (EMD Biosciences/Novagen catalog #71366) containing solutions 1-6, with 100 mg/L ampicillin and 13 mg/L gentamycin were inoculated from the 5 mL cultures. After incubation at 30° C. for 5-6 h, the cultures were moved to a 15° C. incubator. The 15° C. incubations were continued until the $OD_{600}$ of the cultures reached 6 or greater. The cells were harvested by centrifugation, washed with cold 50 mM EPPS, pH 8.4, and then the cell pellets were frozen at −80° C.

Cell extracts were prepared by adding 5 mL per g of cell pellet of BugBuster (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/mL of Benzonase Nuclease (EMD Biosciences/Novagen catalog #70746), and 0.033 μl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the DAT was analyzed using the Bio-Rad Experion Pro260 Automated Electrophoresis Station following the manufacturer's protocol with the cell extracts solutions diluted to 1 mg/mL. The results are shown in Tables 38 and 39.

The electrophoresis results show that the SEQ ID NO:874 polypeptide expressed in a soluble form slightly better than the SEQ ID NO:892 polypeptide using the ArcticExpress™ system. The soluble expression of the Cb DAT varied depending on the colony picked in the transformation plate. None of these DAT polypeptides expressed in a soluble form using the ArcticExpress™ system as well as the SEQ ID NO:894 polypeptide described in Example 16 was expressed.

TABLE 38

| Lane | Sample | Incubation Temperature | Estimated DAT Expression |
|---|---|---|---|
| 1 | Pro260 Ladder | | |
| 2 | ArcticExpress(DE3)::891/pET30a cell extract (colony #1) | 15° C. | 11% |
| 3 | ArcticExpress(DE3)::891/pET30a cell extract (colony #2) | 15° C. | 9% |
| 4 | ArcticExpress(DE3)::873/pET30a cell extract (colony #1) | 15° C. | 15% |
| 5 | ArcticExpress(DE3)::873/pET30a cell extract (colony #2) | 15° C. | 10% |
| 6 | ArcticExpress(DE3)::891/pET30a cell extract (colony #1) | 15° C. | 9% |
| 7 | ArcticExpress(DE3)::891/pET30a cell extract (colony #2) | 15° C. | 8% |

TABLE 38-continued

| Lane | Sample | Incubation Temperature | Estimated DAT Expression |
|---|---|---|---|
| 9 | ArcticExpress(DE3)::873/pET30a cell extract (colony #1) | 15° C. | 15% |
| 10 | ArcticExpress(DE3)::873/pET30a cell extract (colony #2) | 15° C. | 11% |

TABLE 39

| Lane | Sample | Incubation Temperature | Estimated DAT Expression |
|---|---|---|---|
| 1 | Pro260 Ladder | | |
| 2 | ArcticExpress(DE3)::CbDAT in pET30a cell extract (colony #1) | 15° C. | 9% |
| 3 | ArcticExpress(DE3)::CbDAT in pET30a cell extract (colony #2) | 15° C. | 19% |
| 4 | ArcticExpress(DE3)::CbDAT in pET30a cell extract (colony #3) | 15° C. | 13% |
| 5 | ArcticExpress(DE3)::CbDAT in pET30a cell extract (colony #4) | 15° C. | 4% |

Activity Assay Protocol

The enzymatic activity of the DAT polypeptides expressed in the ArcticExpress™ system were tested by following monatin formation in the presence of the aldolase described in Example 6. Each assay tube contained the following (in a total of 3 mL): 0.050 mg/mL aldolase in cell extract (estimating 20% soluble expression); 0.5 mg/mL DAT polypeptide in cell extract (estimating the soluble expression from the Experion data) or purified *B. sphaericus* DAT; 0.01% Tween-80; 200 mM sodium pyruvate; 100 mM D-tryptophan; 50 mM EPPS, pH 8.2; 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen All components except the enzymes were mixed together (the tryptophan did not completely dissolve until at least 1 h after the addition of the enzymes). The reactions were initiated by the addition of the enzymes. Samples were withdrawn at 2, 4.5, 9 and 24 h. Control reactions with purified *B. sphaericus* D-aminotransferase were also run. The concentrations of the substrates and products were measured as described in Example 3. At 24 h, the assays containing the SEQ ID NO:892 or 894 polypeptide had produced approximately the same titer of monatin as the control *B. sphaericus* DAT reaction. The *C. beijerinckii* DAT reaction produced less than one-eighth of the monatin product, while the SEQ ID NO:874 polypeptide produced about half. The stereopurity of the product at 24 h (as determined by the FDAA derivatization protocol in Example 3) was 96% R,R monatin or greater for the SEQ ID NO:892 polypeptide. The concentration of the by-product HMG (4-hydroxy-4-methyl glutamic acid) was measured for the reactions with the SEQ ID NO:892, the SEQ ID NO:894 and the *B. sphaericus* DAT polypeptides. The assay with polypeptides having the sequence shown in SEQ ID NO:894 produced far less of the HMG by-product than the other two (about 20% of that produced by the assay containing the *B. sphaericus* DAT and about 40% of that produced by the assay with the SEQ ID NO:892 polypeptide). The HMG concentrations were estimated by comparing the peak areas of the OPA post-column derivatized samples.

TABLE 40

| | Monatin Formation (mM) | | | |
|---|---|---|---|---|
| Polypeptide (SEQ ID NO:) | 2 h | 4.5 h | 9 h | 24 h |
| *C. beijerinckii* DAT | 0.3 | 0.7 | 0.8 | 0.9 |
| 874 DAT | 1.8 | 3.2 | 4.1 | 4.4 |
| 892 DAT | 1.6 | 3.7 | 5.4 | 8.4 |
| 894 DAT | 1.4 | 2.8 | 4.5 | 8.4 |
| *B. sphaericus* DAT | 1.2 | 2.9 | 4.3 | 8.1 |

These results indicate that when expressed under the appropriate conditions, the polypeptides having the sequence of SEQ ID NO:892 and 894 can be utilized in reactions to produce highly pure R,R monatin at a titer as high as the positive control enzyme.

Example 19

Evaluation of Alternative Expression Hosts to Increase the Soluble Expression of a DAT Because the soluble expression of the SEQ ID NO:894 polypeptide was low when the nucleic acid was expressed in BL21(DE3) (see Example 8), alternative expression hosts were evaluated for improving soluble expression. The OverExpress™ C41(DE3) and C43(DE3) hosts contain genetic mutations phenotypically selected for conferring toxicity tolerance and express some toxic proteins at higher titers than other *E. coli* hosts.

Transformation Protocol

The plasmid SEQ ID NO:893/pET30a was transformed into electrocompetent cells of the OverExpress™ C41(DE3) and C43(DE3) (Lucigen catalog #60341 and 60345, respectively) using a Bio-Rad Gene Pulsar II system following the manufacturer's protocol. The transformation mixtures were recovered in 1 mL SOC medium for 1 hr at 37° C. and plated on LB plates containing 50 mg/L kanamycin. The plates were incubated overnight at 37° C. Multiple colonies were patched onto fresh plates and analyzed for the appropriate insert size using colony PCR. A small aliquot of cells was suspended in 0.025 mL $H_2O$ and incubated at 95° C. for 10 min. After cooling, 2 µL of each of the suspensions were used as the template in 0.025 mL reactions, each also containing 0.5 µL T7 promoter primer (0.1 mM), 0.5 µL T7 terminator primer (0.1 mM), 0.5 µL PCR Nucleotide Mix (Roche #12526720; 10 mM each nucleotide), 2.5 µL Roche Expand DNA polymerase buffer #2, and 0.5 µL Expand DNA polymerase (Roche Expand High Fidelity PCR System catalog #1732650). The 3-step thermocycler program was run for 25-30 cycles: 1 min at 94° C.; 1 min at 54° C., 1.3 min at 72° C. with a final polishing step of 7 min at 72° C.

Expression Studies

Flasks of Novagen Overnight Express™ Autoinduction-System 2 (EMD Biosciences/Novagen catalog #71366) containing solutions 1-6 and 50 mg/L kanamycin (40 mL in each flask) were inoculated from the patch plates of the transformed C41(DE3) and C43(DE3) cells (2 patches for each of the transformations). The cells were incubated at 30° C. overnight and harvested by centrifugation when the $OD_{600}$ reached 6 or greater. The cells were washed with cold buffer, were centrifuged again, and either used immediately or frozen at −80° C.

Cell extracts were prepared by adding 5 mL per g of cell pellet of BugBuster® (primary amine-free) Extraction Reagent (EMD Biosciences/Novagen catalog #70923) with 5

μL/mL of Protease Inhibitor Cocktail II (EMD Bioscience/Calbiochem catalog #539132), 1 μl/mL of Benzonase® Nuclease (EMD Biosciences/Novagen catalog #70746), and 0.033 μl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants carefully removed. Total protein concentrations were determined using the Pierce BCA protein assay kit (Pierce catalog #23225) with bovine serum albumin as the standard and a microtiter plate format. The expression of the DAT polypeptide was analyzed by SDS-PAGE using Bio-Rad Ready Gel® Precast 4-15% polyacrylamide gradient gels (Bio-Rad Laboratories catalog #161-1104). BioRad SDS-PAGE low range standards (catalog #161-0304) were run as standards on each gel. Aliquots of the cell extracts (15 μg protein) were mixed with protein loading buffer containing 2% SDS, 10% glycerol, 12.5% 2-mercaptoethanol, 0.1% bromophenol blue and 62.5 mM Tris-HCl (pH 8), incubated at 95° C. for 5 min, cooled and then loaded on the gel. In addition, the combined soluble and insoluble protein expression (total protein) was analyzed for the transformants. A 10 μl aliquot of each cell suspension before centrifugation was diluted in 90 μL protein loading buffer, incubated at 95° C. for 10 min, and cooled. Ten μL of each cooled solution was loaded on the gel.

The electrophoresis gel shows that the protein expressed better in the C41(DE3) host than in the C43(DE3) host, however the apparent soluble expression was not higher than when BL21(DE3) cells were used.

Example 20

Evaluation of Low Temperature Expression to Increase Soluble DAT Expression

Because the soluble expression of SEQ ID NO:894 D-aminotransferase was low when the gene was expressed in the *E. coli* strain BL21(DE3) (see Example 8), the gene was inserted in vectors with cold shock Protein A promoters to evaluate low temperature expression.

The Takara pCold Expression Vectors are four different vectors that utilize the cold shock Protein A (cspA) promoter for expression of high purity, high yield recombinant protein in *E. coli*. These vectors selectively induce target protein synthesis at low temperatures (15° C.) where the synthesis of other proteins is suppressed and protease activity is decreased. In addition to the cspA promoter, all four vectors contain a lac operator (for control of expression), ampicillin resistance gene (amp$^r$), ColE1 origin of replication, M13 IG fragment, and multiple cloning site (MCS). Three of the vectors also contain a translation enhancing element (TEE), a His-Tag sequence, and/or Factor Xa cleavage site.

Cloning Protocol

The SEQ ID NO:894 DAT nucleic acid from plasmid SEQ ID NO:894pET30a was subcloned into the Takara pCold vectors at the NdeI and XhoI sites of the pCOLDII (contains a TEE and a His-tag sequence), pCOLDIII (contains a TEE) and pCOLDIV vectors. The digested vector and insert bands were gel purified using a QIAquick Gel Extraction Kit (Qiagen catalog #28704) and ligated using a Roche Rapid DNA Ligation Kit (catalog #1635379) following the manufacturer's protocol. The ligation mixtures were transformed into Invitrogen OneShot TOP10 chemically competent cells (catalog #C404003) by heat shock at 42° C. After recovery in 500 μL SOC medium for 1 h at 37° C., the transformation mixtures were plated on LB plates containing 100 mg/L ampicillin and incubated at 37° C. overnight. Colonies were picked from the transformation plates and used to inoculate 5 mL cultures of LB containing 100 mg/mL ampicillin that were incubated overnight at 37° C. Plasmid DNA was purified from the 5 mL cultures using a QIAprep® Spin Miniprep Kit (Qiagen catalog #27104). The inserts were verified restriction digestion with NdeI and XhoI by sequencing (Agencourt Bioscience Corp, Beverly, Mass.).

The SEQ ID NO:894dat pCOLD plasmids were transformed into chemically competent Stratagene ArcticExpress™ (DE3) cells and Novagen BL21(DE3) cells following the manufacturers' protocols. The transformation mixtures were recovered in 0.5-1 mL SOC medium for 1 h at 37° C. and plated on LB plates containing 100 mg/mL ampicillin and 13 mg/L gentamycin (ArcticExpress™ (DE3)) or 100 mg/mL ampicillin (BL21(DE3)). The plates were incubated overnight at 37° C.

Expression Studies

Flasks of Novagen Overnight Express™ Autoinduction-System 2 (EMD Biosciences/Novagen catalog #71366) containing solutions 1-6 and 100 mg/L ampicillin and 13 mg/L gentamycin (ArcticExpress™ (DE3)) or 100 mg/mL ampicillin (BL21(DE3) were inoculated from the patch plates of the transformed cells (2 patches for each of the SEQ ID NO:893/pCOLDII, SEQ ID NO:893/pCOLDIII and SEQ ID NO:893/pCOLDIV transformations).

After incubation at 30° C. for 3-5 hr the cultures were moved to a 15° C. incubator. The 15° C. incubations were continued until the OD at 600 nm of the cultures reached 6 or greater. The cells were harvested by centrifugation, washed with cold buffer, and then the cell pellets were frozen at −80° C.

Cell extracts were prepared by adding 5 mL per g of cell pellet of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μL/mL of Benzonase® Nuclease (EMD Biosciences/Novagen catalog #70746), and 0.033 μl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion™ Pro260 Automated Electrophoresis Station following the manufacturer's protocol with the cell extract solutions diluted to 1 mg/mL. The results are shown in Tables 41 and 42.

TABLE 41

| Lane | Sample | Estimated % DAT Expression |
|---|---|---|
| L | Pro260 Ladder | |
| 1 | BL21(DE3)::SEQ ID NO: 893/pCOLDII#1 | 8.7 |
| 2 | BL21(DE3)::SEQ ID NO: 893/pCOLDII#2 | 8.5 |
| 3 | ArcticExpress™(DE3)::SEQ ID NO: 893/pCOLDII#1 | 9.8 |
| 4 | ArcticExpress™(DE3)::SEQ ID NO: 893/pCOLDII#2 | 6.4 |

TABLE 42

| Lane | Sample | Estimated % DAT Expression |
|---|---|---|
| L | Pro260 Ladder | |
| 1 | BL21(DE3)::SEQ ID NO: 893/pCOLDIII#1 | 4.3 |
| 2 | BL21(DE3)::SEQ ID NO: 893/pCOLDIII#2 | 2.3 |
| 3 | BL21(DE3)::SEQ ID NO: 893/pCOLDIV#1 | 14.6 |
| 4 | BL21(DE3)::SEQ ID NO: 893/pCOLDIV#2 | 14.2 |
| 5 | BL21(DE3)::SEQ ID NO: 893/pCOLDIII#1 | 4.4 |
| 6 | BL21(DE3)::SEQ ID NO: 893/pCOLDIII#2 | 5.2 |
| 7 | BL21(DE3)::SEQ ID NO: 893/pCOLDIV#1 | 13.8 |
| 8 | BL21(DE3)::SEQ ID NO: 893/pCOLDIV#2 | 16.1 |
| 9 | BL21(DE3)::SEQ ID NO: 893/pCOLDIV#1 | 16.2 |
| 10 | BL21(DE3)::SEQ ID NO: 893/pCOLDIV#2 | 16.8 |

The Experion Pro260 results show that the SEQ ID NO:894 DAT protein expressed better when the nucleic acid was incorporated in the pCOLDIV vector than in either the pCOLDII or pCOLDIII vector. From the experiments shown above, the average expression level for SEQ ID NO:893/pCOLDII was about 8%, regardless of expression host used; the average expression level for SEQ ID NO:893/pCOLDIII was about 4%, while the average expression level for SEQ ID NO:893/pCOLDIV was ~15%. These expression levels are significantly less than those described in Examples 16 when the SEQ ID NO:893 nucleic acid was co-expressed with the GroEL-GroES chaperones and in Example 17 when the nucleic acid was expressed in the Stratagene ArcticExpress™ system.

Example 21

Codon Modification of a DAT

An attempt to improve the solubility of the SEQ ID NO:894 polypeptide expressed in *E. coli* was undertaken with the presumption that, slowing the rate of translation in *E. coli* would allow more time for proper folding of the SEQ ID NO:894 polypeptide, thereby giving a higher expression of soluble protein. A BLAST search (NCBI) of the SEQ ID NO:894 polypeptide sequence revealed that some of the most closely related public sequences were from *Clostridium* species, specifically *Clostridium beijerinckii*. Example 9 describes the results from cloning, expressing, and assaying the CbDAT and its use in monatin formation reactions. Specifically, expression was high in the total protein fraction but very low in the soluble protein fraction.

The codon usage tables of *C. beijerinckii* and *E. coli* K12 were compared. Several rarely used codons in *C. beijerinckii* were found to be highly abundant in *E. coli* K12 (Table 43). It is possible that these rare codons cause translational pauses in *C. beijerinckii*., whereas in an *E. coli* K12 host, there may not be a pause. In the SEQ ID NO:894 sequence, 4 doublets were identified in which tandem rare codons for *C. beijerinckii* had become "non-rare" (i.e. abundant) in *E. coli* K12. The goal was to change these codons into rare codons for expression in *E. coli* K12 host using the *E. coli* K12 codon usage table. Primers were designed to change these doublets. SEQ ID NO:893/pET30a (described in Example 4) was used as a template and mutation was carried out according to the Stratagene QuickChange kit instructions. The primers utilized to modify the SEQ ID NO:893 nucleic acid sequence are shown below, along with the native gene (the targeted doublet sequences are underlined).

TABLE 43

| Original Codons | Codon Usage (per thousand) | | Altered Codons | Codon Usage |
|---|---|---|---|---|
| | *C. beijerinckii* | *E. coli* | | *E. coli* |
| GCC | 3.7 | 25.6 | GCT | 15.3 |
| CTG | 1.4 | 52.9 | CTA | 3.9 |
| ACC | 2.5 | 23.5 | ACA | 7.0 |
| CGC | 0.8 | 22.0 | CGA | 3.5 |
| GCG | 2.9 | 33.8 | GCT | 15.3 |
| CCG | 1.1 | 23.3 | CCC | 5.4 |

```
>native sequence
                                                         SEQ ID NO: 893
ATGGACGCACTGGGATATTACAACGGAAAATGGGGGCCTCTGGACGAGATGACCGTGCCGATGAAC

GACAGGGGTTGTTTCTTTGGGGACGGAGTGTACGACGCTACCATCGCCGCTAACGGAGTGATCTTTGCCCTG

GACGAGCACATTGACCGGTTTTTAAACAGCGCAAAGCTCCTGGAAATAGAAATCGGTTTTACAAAAGAGGAA

TTAAAAAAAACTTTTTTTGAAATGCACTCCAAAGTGGATAAAGGGGTGTACATGGTTTATTGGCAGGCGACT

CGCGGAACAGGCCGTCGAAGCCATGTATTTCCGGCAGGTCCCTCAAATCTCTGGATTATGATTAAGCCCAAT

CACGTCGACGATCTTTATAGAAAAATCAAGCTCATTACCATGGAAGATACCCGCTTCCTCCACTGCAACATC

AAGACCCTTAACCTTATTCCCAATGTCATTGCCTCCCAGCGGGCGCTGGAAGCGGGCTGCCACGAGGCGGTC

TTTCACCGGGTGAAACAGTAACCGAGTGCGCCCACAGCAATGTCCACATCATTAAAAACGGCAGGTTTATC

ACCCACCAGGCGGACAACCTAATCCTTCGGGGCATAGCCCGTAGCCATTTATTGCAAGCCTGTATCAGGCTG

AACATTCCATTTGACGAACGGGAATTTACCCTTTCGGAATTATTTGACGCGGATGAGATTCTTGTGTCCAGC

AGCGGCACACTCGGCCTTAGCGCCAATACAATTGATGGAAAAAACGTGGGGGGAAAAGCGCCGGAACTGCTA

AAAAAAATTCAGGGCGAAGTGTTGAGGGAATTTATCGAAGCGACAGGCTACACGCCTGAGTGGAGCACAGTA

TAG
```

```
Primers for Doublet 1 mutant
                                                         (SEQ ID NO: 1074)
CTAACGGAGTGATCTTTGCTCTAGACGAGCACATTGAC (SEQ ID NO: 1075)
GTCAATGTGCTCGTCTAGAGCAAAGATCACTCCGTTAG Primers for Doublet 2 mutant
                                                         (SEQ ID NO: 1076)
CATGGAAGATACACGATTCCTCCACTGCAACATCAAGAC (SEQ ID NO: 1077)
GTCTTGATGTTGCAGTGGAGGAATCGTGTATCTTCCATG Primers for Doublet 3 mutant
                                                         (SEQ ID NO: 1078)
ATTGCCTCCCAGCGGGCTCTAGAAGCGGGCTGCCACG (SEQ ID NO: 1079)
CGTGGCAGCCCGCTTCTAGAGCCCGCTGGGAGGCAAT Primers for Doublet 4 mutant
                                                         (SEQ ID NO: 1080)
GGGGGGAAAAGCTCCCGAACTGCTAAAAAAATTCAGG (SEQ ID NO: 1081)
CCTGAATTTTTTTTAGCAGGTCGGGAGCTTTTCCCCCC
```

Clones with the correctly altered sequence were transformed into BL21(DE3) host for enzyme expression assays. Enzyme expression was determined by growing the cells overnight in Overnight Express II and lysing the cells with BugBuster reagent followed by SDS PAGE analyses of crude cell extract and soluble protein.

It appeared that there was a slight improvement in soluble protein expression with codon changes to doublets 1, 2 and 3. Codon changes at doublet 4 were not beneficial for soluble protein expression. Codon changes for doublets 1, 2 and 3 were combined in pairs using the Stratagene QuickChange kit and the primers designed for the initial codon changes. Clones with the correctly altered sequence were transformed into BL21(DE3) host for enzyme expression assays. Enzyme expression was determined by growing the cells overnight in Overnight Express II and lysing the cells with BugBuster reagent followed by SDS PAGE analyses of crude cell extract and soluble protein. The combinations of mutations to doublets 1 and 2, 2 and 3 and 1 and 3 yielded soluble protein bands visible on an SDS-PAGE gel. However, there still appeared to be more protein in the total protein fractions.

Example 22

The Evaluation of Periplasmic Expression of a DAT Polypeptide

Because the soluble expression of the SEQ ID NO:894 polypeptide was low when the gene product was expressed as a cytoplasmic protein in the *E. coli* host BL21(DE3) (see Example 8), the gene was cloned into vectors to generate fusion proteins that should be exported into the periplasmic space. The periplasm provides conditions that promote proper folding and disulfide bond formation and may enhance the solubility and activity of certain target proteins.

Cloning into EMD Biosciences/Novagen pET26b allows production of the target protein with a periplasmic signal sequence. The signal sequence is cleaved by signal peptidase concomitant with export. The EMD Biosciences/Novagen pET39b and pET40b are designed for cloning and expression of target proteins fused with a 208 amino acid DsbA-Tag™ or 236 amino acid DsbC-Tag™. DsbA and DsbC are periplasmic enzymes that catalyze the formation and isomerization of disulfide bonds, respectively. The fusion proteins are typically localized in the periplasm.

Cloning Protocol

The SEQ ID NO:893 nucleic acid from plasmid SEQ ID NO:893/pET30a (described in Example 4) was cloned into the EMD Biosciences/Novagen pET26b (catalog #69862-3), pET39b (catalog #70090-3), and pET40b (catalog #70091-3) vectors at the EcoRI and NotI sites of the vectors. The DATs nucleic acid with a 5' EcoRI site and a 3' NotI site was generated using the amplification protocol described in Example 4 and the following primers:

```
                                                 (SEQ ID NO: 1082)
5'-CGCAGAATTCGGACGCACTGGGATATTACAAC-3'

(SEQ ID NO: 1083)
5'-GTTAGCGGCCGCCTATACTGTCCTCCACTCAG-3'
```

The restriction sites are in italics in the primer sequences. The resulting DNA product and the pET26b, pET39b and pET40b vectors were digested with EcoRI and Not I (New England Biolabs) following the suggested manufacturer's protocol. The vector reaction mixtures were subsequently treated with Shrimp Alkaline Phosphatase (Roche catalog #1758250). The digested vector and insert bands were gel purified from a 1% agarose gel using a Qiagen QIAquick® Gel Extraction Kit (catalog #28704) and ligated using a Roche Rapid Ligation Kit (catalog #1635379) following the manufacturer's protocol. The ligation mixtures were transformed into Invitrogen OneShot® TOP10 chemically competent cells (catalog #C404003) by heat shock at 42° C. After recovery in 500 µL SOC medium for 1 h at 37° C., the transformation mixtures were plated on LB plates containing 50 mg/L kanamycin and incubated at 37° C. overnight. Colonies were picked from the transformation plates and used to inoculate 5 mL cultures of LB containing 50 mg/mL kanamycin that were incubated overnight at 37° C. Plasmid DNA was purified from the 5 mL cultures using a Qiagen QIAprep spin miniprep kit (catalog #27104). The nucleic acid sequences were verified by sequencing (Agencourt Bioscience Corp, Beverly, Mass.). Plasmids with the correct insert sequences were transformed into EMD Biosciences/Novagen BL21(DE3) chemically competent cells (catalog #69450) by heat shock as described above.

Expression Studies

Flasks of Novagen Overnight Express™ Autoinduction-System 2 (EMD Biosciences/Novagen catalog #71366) containing solutions 1-6 and 50 mg/L kanamycin (50 mL in each flask) were inoculated from fresh plates of BL21(DE3) cells carrying the SEQ ID NO:893 DAT nucleic acid (encoding the polypeptide of SEQ ID NO:894) in either pET26b, pET39b or pET40b. The cells were incubated at 30° C. overnight and harvested by centrifugation when the $OD_{600}$ reached 6 or greater. The cells were washed with cold buffer, were centrifuged again, and used immediately or the cell pellets were frozen at –80° C. Before harvesting, 2 mL culture aliquots were withdrawn from each flask for soluble and total protein (soluble and insoluble) expression analyses. Cell extracts were prepared as described in Example 16. Total protein samples were prepared by suspending a small amount of cell pellet in protein loading buffer containing 2% SDS, 10% glycerol, 12.5% 2-mercaptoethanol, 0.1% bromophenol blue and 62.5 mM Tris-HCl, pH 8, and incubating at 95° C. for 10 min.

The periplasmic cellular fractions were prepared from the remainder of the cells from each culture following the protocol described in the EMD Biosciences/Novagen pET System Manual. The resulting fractions were concentrated 30-fold using Amicon Ultracel 10 k centrifugal filter devices (Millipore catalog #UFC901024). Total protein concentrations of the cell extracts and the periplasmid fractions were determined using the Pierce BCA protein assay kit (Pierce catalog #23225) with Bovine Serum Albumin as the standard and a microtiter plate format. Fifteen μg protein samples of the cell extracts and 10 μg protein samples of the periplasmic fractions were analyzed by SDS-PAGE using Bio-Rad Ready Gel® Precast 4-15% polyacrylamide gradient gels (Bio-Rad Laboratories catalog #161-1104). In addition, the total protein samples were analyzed by SDS-PAGE. BioRad SDS-PAGE low range standards (catalog #161-0304) were run as standards on each gel.

Analysis of the total protein SDS-PAGE gel shows that proteins with the predicted molecular weights expressed using the Overnight Express™ AutoinductionSystem 2. However, analysis of the SDS-PAGE gel loaded with the cell extract fractions or with the periplasmic fractions suggests that these proteins did not express solubly nor were they exported into the periplasm.

Example 23

Production of Monatin from Indole-3-Pyruvate

The maximum concentration of monatin obtained when D-tryptophan and pyruvic acid are the starting raw materials in the monatin formation assay described in Example 5 is limited by the solubility of tryptophan. In order to explore the potential of using an aldolase and the SEQ ID NO:220 DAT polypeptide (described in Example 14) in reaching higher monatin concentrations, the reaction starting with indole-3-pyruvatr (I3P) and pyruvate acid as raw materials were analyzed. In this case, it was also necessary to provide an amino donor such as D-alanine or both D-alanine and D-tryptophan.

The test was conducted using purified SEQ ID NO:220 DAT polypeptide (production and purification described in Example 15) and an aldolase (described in Example 6). The reaction was set up as follows (in a total of 1 mL): 200 mM Indole-3-pyruvate (I3P); 200 mM sodium pyruvate; 400 mM D-alanine; 100 mM EPPS, pH 8.0; 1 mM $MgCl_2$; 0.05 mM PLP; and 10 mM potassium phosphate.

Both enzymes were added in excess to facilitate conversion to monatin to minimize competion from non-enzymatic degradation reactions. The reactions were incubated at room temperature in a Coy Laboratory Products, Inc. anaerobic chamber to minimize exposure to oxygen All components except the enzymes were mixed together and the pH was adjusted to 8.0. The reactions were initiated by the addition of the enzymes (0.04 mg/mL aldolase as cell extract (assuming 20% expression) and 0.40 mg/mL purified SEQ ID NO:220 DAT polypeptide).

In some tests as indicated in the table below, D-tryptophan was also added at either 50 or 100 mM in addition to the D-alanine to act as amino donor and also to limit the amount of indole-3-pyruvate consumed in the formation of D-tryptophan. The monatin formation was measured after 18 hours using the LC/MS/MS methodology described in Example 3, and the results are presented in Table 44 below.

TABLE 44

| Monatin Formation from I3P (mM) | |
|---|---|
| Reactant initial concentrations (mM) | Monatin concentration (mM) |
| 200 I3P; 200 pyr: 400 D-ala | 44.9 |
| 200 I3P; 200 pyr: 400 D-ala, 50 D-trp | 47.8 |
| 200 I3P; 200 pyr: 400 D-ala, 100 D-trp | 61.0 |

As shown above, the aminotransferase and aldolase enzymes were active at the higher reactant concentrations and a much higher monatin concentration was achieved.

At 18 h, while using 200 mM indole-3-pyruvate, 200 mM sodium pyruvate and 100 mM D-tryptophan, the concentration of monatin was 61 mM. A small increase in monatin production (47.8 mM) was observed under the conditions of the assay, with the addition of 50 mM D-tryptophan vs. just using 400 mM D-alanine.

Example 24

Homology Table

Table 45 shows some of the most active DAT polypeptides and the corresponding closest homologs from the published databases or literature.

TABLE 45

| DAT polypeptide (SEQ ID NO:) | Closest Hit from Database | % Sequence Identity |
|---|---|---|
| 896 | *Bacillus* sp. YM-1 | 76 |
| 874 | Serine glyoxylate transaminase from *Acidiphilium cryptum* JF-5 (NR Accession No: 148260372) | 51 |

TABLE 45-continued

| DAT polypeptide (SEQ ID NO:) | Closest Hit from Database | % Sequence Identity |
|---|---|---|
| 878 | Putative glutamate-1-semialdehyde 2,1-aminomutase from *Planctomyces maris* DSM 8797 (NR Accession No. 149173540) | 43 |
| 882 | D-alanine transaminase from *Oceanobacter* sp. RED65 (NR Accession No: 94500389) | 57 |
| 910 | DAT from *B. macerans* | 91 |
| 176 | D-amino acid aminotransferase from *Clostridium beijerincki* (NCIMB 8052) | 62 |
| 220 | D-amino acid aminotransferase from *Clostridium beijerincki* (NCIMB 8052) | 62 |
| 156 | Aminotransferase class-III (leadered) from *Chloroflexus aggregans* DSM 9485 (NR Accession No: 118045454) | 46 |
| 214 | D-amino acid aminotransferase from *Clostridium beijerincki* (NCIMB 8052) | 61 |
| 918 | Aminotransferase class IV from *Robiginitalea biformata* HTCC2501 (NR Accession No: 88806011) | 57 |
| 902 | Putative glutamate-1-semialdehyde 2; 1-aminomutase from *Planctomyces maris* DSM 8797 (same protein as above) | 46 |
| 884 | D-alanine transaminase from *Thiobacillus denitrificans* ATCC 25259 (NR Accession No: 74316285) | 40 |
| 866 | D-alanine aminotransferase from *Lactobacillus salivarius* subsp. *salivarius* UCC118 | 49 |
| 946 | D-amino acid aminotransferase from *Clostridium beijerincki* (NCIMB 8052) | 63 |

As shown in Example 9, homologs of the polypeptides having the sequence shown in SEQ ID NO:866, 946, 220, and 176 were cloned and also had activity in the production of R,R monatin, despite a sequence identity among those polypeptides of between 49% and 63%. Similarly, the predicted D-alanine transaminase from *Oceanobacter* species and the *Robinginitalea biformata* aminotransferase are expected to have broad D-amino acid aminotransferase activity like the DAT polypeptides having the sequence of SEQ ID NO:882 and 918.

Example 25

Construction and Testing of GSSM$^{SM}$ Mutants

This example describes the construction of exemplary nucleic acids and polypeptides, and describes their enzymatic activity. The nucleotide sequence (SEQ ID NO:219) was subcloned into pSE420-C-His vector and expressed in *E. coli* XL1-BLUE host (Stratagene, La Jolla, Calif.) to produce the exemplary D-aminotransferase (DAT) enzyme having the amino acid sequence shown in SEQ ID NO:220. The pSE420-C-His vector was created by adding a C-terminal His-tag to the pSE420 vector from Invitrogen (Carlsbad, Calif.). Construct SEQ ID NO:220 (in *E. coli* XL1-BLUE), was used as a starting sequence into which modifications were introduced and is referred to herein as the wild type (WT) sequence. A first round of modification (i.e., single-residue mutations) was performed using Gene Site Saturated Mutagenesis$^{SM}$ (GSSM$^{SM}$) technology (see, for example, U.S. Pat. No. 6,171,820). The mutants made using GSSM$^{SM}$ technology were expressed in the pSE420-C-His vector in *E. coli* host XL1-BLUE, arrayed into 384-well plates and grown at 37° C. overnight. Samples were subcultured and grown at 30° C. for two nights (36-48 hours). Cultures were frozen at −20° C. until cell lysates could be prepared.

Cells were lysed by addition of 10 µL of BPER II (Thermo Scientific, Rockford, Ill.) to each well. Samples were mixed three times and lysed on ice for one hour. Crude lysates were then assayed in the primary screen. 25 µL of crude lysate was assayed with 1 mM R,R-monatin, 25 mM pyruvic acid sodium salt, 0.08 mM PLP in 50 mM sodium phosphate (pH 8) at room temperature. After three hours, an aliquot was taken and formic acid was added to a final concentration of 2%. Samples were diluted with water to be within the range of the standard curve. Samples were analyzed for monatin consumption and alanine formation using the LC/MS/MS methods described in Example 1 (LC/MS/MS Method for Detecting D-alanine or R,R-monatin). Sample performance was compared to the performance of the wild type control (i.e., SEQ ID NO:220).

Mutants that outperformed the wild type control were selected as hits from the GSSM$^{SM}$ primary screen. Glycerol stocks of the primary hits were used to inoculate new 384-well plates. The hits were arrayed in quadruplicate, grown and lysed as indicated for the primary screen. The primary hits were then tested in a secondary screen. The secondary screen method was the same as for the primary screen except the mutants were tested with 1 mM and 15 mM R,R-monatin substrate. Samples were analyzed for monatin consumption and alanine formation using LC/MS/MS. Sample performance was compared to the performance of the wild type control.

Sample performance was evaluated using a scoring system based on alanine production and monatin consumption. The maximum score for a single sample was six. A maximum of three points were assigned for alanine production and a maximum of three points were assigned for monatin consumption. The scoring criteria were as follows: 1 point assigned for a value between average and one standard deviation of the positive control; 2 points assigned for a value between one and two standard deviations of the positive control; and 3 points assigned for a value beyond two standard deviations of the positive control.

The highest potential total score for a mutant was 48 (since the samples were screened in quadruplicate at 1 and 15 mM monatin). In general, mutants scoring 20 points or more were selected as secondary hits. However, some exceptions were made for samples scoring less than 20 points. Samples with alanine formation and monatin consumption values on the verge of the threshold requirements were also selected as hits. This prevented the premature elimination of hits and allowed for further testing and characterization in the tertiary screen.

Samples identified as secondary screen hits, using the criteria above, are listed in Table 46. Secondary hits were streaked from glycerol stocks onto LB agar plates containing 100 µg/mL carbenicillin and grown overnight at 37° C. Single colonies were used to inoculate 1 mL LB containing carbenicillin (100 µg/mL). Cultures were grown overnight at 37° C. DNA was isolated from the cultures, and then prepared and sequenced using 3730XL automated sequencers (Applied Biosystems, Foster City, Calif.).

Mutations and the amino acid position of the mutation for secondary hits are listed below in Table 46. Numbering of the amino acid positions starts with the N-terminal methionine. For example, the first mutation listed "Y6L" refers to changing the tyrosine in amino acid position 6 of the wild type enzyme (SEQ ID NO:220) to leucine. At the nucleic acid level, any codon which codes for the desired (mutated) amino acid can be used.

All of the amino acid sequences described in Tables 46, 47 and 53, below, are exemplary polypeptides; also provided are nucleic acid sequences that encode such polypeptides.

Example 26

List of GSSM$^{SM}$ Mutations

TABLE 46

GSSM$^{SM}$ Mutants Identified as Secondary Screen Hits

| Mutant name | Mutation |
|---|---|
| 1 | Y6L |
| 2 | Y6C; SILENT MUTATION AT AA31 (GGC → GGT) |
| 3 | Y6F |
| 4 | Y6L |
| 5 | Y6H |
| 6 | Y6L |
| 7 | Y6M |
| 8 | N10S |
| 9 | N10W |
| 10 | N10T |
| 11 | N10R |
| 12 | N10T |
| 13 | L14V |
| 14 | L14L |
| 15 | G41G |
| 16 | T18W |
| 17 | N40N |
| 18 | V19T |
| 19 | V42V |
| 20 | I62C |
| 21 | V82A |
| 22 | A57M |
| 23 | V42M |
| 24 | G41Y |
| 25 | A45L |
| 26 | V93Y |
| 27 | V93G |
| 28 | L46A |
| 29 | L46H |
| 30 | G98A |
| 31 | P20S |
| 32 | V93A |
| 33 | V103T |
| 34 | P108F |
| 35 | V93L |

TABLE 46-continued

GSSM$^{SM}$ Mutants Identified as Secondary Screen Hits

| Mutant name | Mutation |
|---|---|
| 36 | S101S |
| 37 | A106G |
| 38 | S101Q |
| 39 | P108T |
| 40 | N118G |
| 41 | P108C |
| 42 | I120L |
| 43 | A106W |
| 44 | N118R |
| 45 | N110A; N118G |
| 46 | N118A |
| 47 | N118R |
| 48 | P117W; N118K |
| 49 | D133N |
| 50 | K126Q |
| 51 | K126R |
| 52 | K128S |
| 53 | I127M |
| 54 | T131T |
| 55 | D133L |
| 56 | M132A |
| 57 | D133E |
| 58 | L129V |
| 59 | K126K |
| 60 | I130M |
| 61 | M132Y |
| 62 | K128R |
| 63 | M132R |
| 64 | L129I |
| 65 | K128L; D2D (GAC → GAT) |
| 66 | F137W |
| 67 | I152V |
| 68 | N55L |
| 69 | N150S |
| 70 | L138L |
| 71 | P149P |
| 72 | G161G |
| 73 | A165T |
| 74 | H163R |
| 75 | H163K |
| 76 | H168A |
| 77 | E171S |
| 78 | E171R |
| 79 | E171R |
| 80 | T172I |
| 81 | C176G |
| 82 | A177S |
| 83 | A177S |
| 84 | S80L; R156W |
| 85 | H182G |
| 86 | N186S |
| 87 | K185R |
| 88 | K185T |
| 89 | D2H |
| 90 | D2T; E260G |
| 91 | D2Y |
| 92 | D2G |
| 93 | D2Q |
| 94 | D2F |
| 95 | D2A |
| 96 | D2T |
| 97 | D2N |
| 98 | D2R |
| 99 | D2I |
| 100 | D2V; G9A |
| 101 | G12A |
| 102 | D47W |
| 103 | S56S |
| 104 | I64H |
| 105 | L66L |
| 106 | I64C |
| 107 | L66G |
| 108 | E69Y |
| 109 | T74L |
| 110 | K73L |

TABLE 46-continued

GSSM^SM Mutants Identified as Secondary Screen Hits

| Mutant name | Mutation |
|---|---|
| 111 | T74V |
| 112 | T74M |
| 113 | T74R |
| 114 | T74A |
| 115 | N76C |
| 116 | E77R |
| 117 | R156A |
| 118 | K72M |
| 119 | S205A |
| 120 | Q209S |
| 121 | V212E |
| 122 | R213W |
| 123 | I216T |
| 124 | P217H |
| 125 | P217V |
| 126 | D219F |
| 127 | E220V |
| 128 | R221E |
| 129 | F223C |
| 130 | S226P |
| 131 | L228F |
| 132 | V234A |
| 133 | S238S |
| 134 | V236T |
| 135 | V236T |
| 136 | T241R |
| 137 | L242F |
| 138 | T241R |
| 139 | T241C |
| 140 | E248F |
| 141 | D250E |
| 142 | K257V |
| 143 | G256K |
| 144 | E260G |
| 145 | L262R |
| 146 | K263M |
| 147 | D267G |
| 148 | D267R |
| 149 | I265L |
| 150 | E268S |
| 151 | L270S |
| 152 | L270G |
| 153 | L270W |
| 154 | R271S |
| 155 | I274W |
| 156 | G278S |
| 157 | Y279C |
| 158 | S284R |
| 159 | E282G |
| 160 | T280N |
| 161 | V286G |
| 162 | R285F |
| 163 | V286R |
| 164 | G240G |
| 165 | E61R |
| 166 | E61D |
| 167 | E61Y |
| 168 | G85G |
| 169 | G85D |
| 170 | S80R |
| 171 | Y79R |
| 172 | Y79V |
| 173 | W283V |
| 174 | W283E |
| 175 | W283A |
| 176 | W283S |
| 177 | W283G |
| 178 | W283A |
| 179 | W283R |
| 180 | W283T |
| 181 | P281W |
| 182* | V236T; T241R |

*Mutant 182 was created using site-directed mutagenesis, using Mutant 136 DNA as a template and then introducing the V236T mutation. One skilled in the art can synthesize this gene using site-directed mutagenesis techniques.

Samples listed in Table 46 were then prepared for the tertiary screen. Glycerol stocks were used to inoculate 5 mL of LB containing 100 µg/mL carbenicillin. Cultures were grown overnight at 37° C. The overnight cultures were then used to inoculate 50 mL cultures of LB containing 100 µg/mL carbenicillin in 250 mL baffled flasks to $OD_{600nm}$ of 0.05. IPTG was added to a final concentration of 1 mM when the $OD_{600nm}$ reached 0.4-0.8. Cultures were induced overnight at 30° C. Cell pellets were harvested by centrifugation at 6,000 rpm for 20 minutes. Cell pellets were frozen at −20° C. until cell lysates could be prepared. Cells were lysed with BPER II (Thermo Scientific, Rockford, Ill.) on ice for 1 hour. Clarified lysates were prepared by centrifugation at 12,000 rpm for 30 minutes.

Protein was quantified by Bio-Rad Bradford Protein Assay (Bio-Rad, Hercules, Calif.) per the manufacturer's instructions. SDS-PAGE analysis and densitometry were used to determine the amount of expressed D-aminotransferase. Samples were normalized for expressed D-aminotransferase. 0.02 mg/mL D-aminotransferase was tested in the tertiary screen. The tertiary screening method was the same as the secondary screening method except that samples were taken at 0, 5, 10, 15, 30, 60, 120 and 210 minutes to develop a timecourse. Alanine production and monatin consumption values were measured by LC/MS/MS analysis and compared to a standard curve. Samples were compared to the wild type control.

Samples with higher final titers or faster initial rates than the wild type control were identified as hits and are referred to as upmutants. The GSSM^SM upmutants identified in the tertiary screen are listed in Table 47. These upmutants are further described in Example 27 below.

Example 27

Enzymatic Activity of Polypeptides Upmutants

This example describes data demonstrating the enzymatic activity of exemplary upmutant polypeptides disclosed herein, e.g., the polypeptides having amino acid sequences described in Table 47. Table 47 shows the activity of the upmutants relative to the wild type control at the 15 minute time point in reactions using 1 mM and 15 mM R,R-Monatin substrate. Relative activity is the amount of alanine produced by the sample divided by the amount of alanine produced by the wild type control.

TABLE 47

Activity of GSSM Upmutants in Tertiary Screen

| | | Activity relative to wild type control (SEQ ID NO: 220) | |
|---|---|---|---|
| Mutant | Mutation | Reaction with 1 mM monatin substrate | Reaction with 15 mM monatin substrate |
| 23 | V42M | 1.28 | 1.04 |
| 24 | G41Y | 1.37 | 1.31 |
| 27 | V93G | 1.73 | 1.98 |
| 31 | P20S | 1.29 | 1.60 |
| 35 | V93L | 1.14 | 0.96 |
| 40 | N118G | 2.61 | 1.52 |
| 44 | N118R | 1.55 | 0.47 |
| 45 | N110A; N118G | 2.50 | 2.02 |
| 46 | N118A | 2.28 | 0.69 |
| 48 | P117W; N118K | 2.54 | 1.12 |
| 58 | L129V | 1.04 | 0.85 |
| 66 | F137W | 1.25 | 1.44 |
| 67 | I152V | 1.19 | 1.24 |
| 81 | C176G | 1.11 | 1.27 |
| 82 | A177S | 1.24 | 1.02 |
| 104 | I64H | 1.37 | 1.07 |
| 109 | T74L | 1.37 | 1.31 |
| 110 | K73L | 2.83 | 3.75 |
| 111 | T74V | 1.99 | 2.19 |
| 112 | T74M | 1.78 | 2.01 |
| 135 | V236T | 3.44 | 2.88 |
| 136 | T241R | 2.64 | 1.79 |
| 152 | L270G | 1.24 | 0.89 |
| 153 | L270W | 2.00 | 1.54 |
| 174 | W283E | 1.23 | 0.84 |
| 175 | W283A | 1.61 | 1.09 |
| 177 | W283G | 1.71 | 1.06 |
| 6 | Y6L | 2.52 | 2.21 |
| 88 | K185T | 1.04 | 0.95 |
| 107 | L66G | 1.08 | 1.02 |

Several samples were identified that outperformed the wild type control under the conditions tested. Potential $K_m$ and $V_{max}$ upmutants were identified. These results indicate that the wild type control (SEQ ID NO:220) is further evolvable for increased specific D-aminotransferase activity on monatin.

Example 28

Activity of GSSM$^{SM}$ Mutants in Monatin Process Analysis of GSSM DATs in pSE420-C-His This example describes data demonstrating the enzymatic activity of exemplary polypeptides disclosed herein. Mutant 27, Mutant 44, Mutant 58, Mutant 119, Mutant 135, Mutant 136, Mutant 152, Mutant 154 and the wild type control (in vector pSE420-C-His in *E. coli* XL1-Blue, as described in Examples 25 and 26) were streaked onto agar plates containing LB medium with ampicillin (100 μg/mL). Single colonies were used to inoculate 5 mL of LB medium containing ampicillin (100 μg/mL). Five hundred μl were used to inoculate 50 mL of the same medium in a 250 mL baffled flask. The cells were grown at 30° C. to approximately an OD$_{600nm}$ of 0.4. IPTG was added to a final concentration of 1 mM. Cells were grown at 30° C. for 4 hours and collected by centrifugation. Cells were immediately frozen at −80° C. until cell extracts were prepared.

Cell extracts were prepared as described in Example 4. Protein concentrations were determined using the BCA (Pierce, Rockford, Ill.) microtiter plate assay with BSA (Pierce Rockford, Ill.) as the standard, per the manufacturer's instructions. To estimate the concentration of the D-aminotransferase in the cell-free extracts, SDS-PAGE analysis was done and visual estimation was used to estimate percentage of expression. The DAT proteins were soluble in the range of 10-25% expression as percentage of total protein and this was used to calculate the dosage of the assays.

An R,R monatin formation assay was performed containing 100 mM EPPS buffer pH 7.8, 1 mM MgCl$_2$, 0.05 mM PLP, 200 mM sodium pyruvate, 10 mM potassium phosphate, 0.01% Tween-80 with 0.1 mg/mL aldolase and 0.2 mg/mL of DAT in a 4 mL reaction at room temperature. Mutant 27 used 0.15 mg/mL of DAT enzyme instead of 0.2 mg/mL. After 0.5, 1, 2, 4 and 23 hours, an aliquot was taken, formic acid was added to a final concentration of 2%, and the samples spun and filtered. Samples were analyzed for monatin using the LC/MS/MS methodology described in Example 36. Results are shown in Table 48.

TABLE 48

Activity of DATs (cloned into pSE420-C-His)

| DAT of polypeptide | Monatin (mM) 0.5 hr | Monatin (mM) 1 hr | Monatin (mM) 2 hr | Monatin (mM) 4 hr |
|---|---|---|---|---|
| wild type control | 2.12 | 5.26 | 9.34 | 13.05 |
| Mutant 27 | 4.74 | 9.55 | 14.72 | 18.06 |
| Mutant 44 | 3.73 | 6.61 | 10.38 | 13.23 |
| Mutant 58 | 3.61 | 7.51 | 11.85 | 14.56 |
| Mutant 135 | 3.50 | 7.72 | 12.50 | 16.17 |
| Mutant 136 | 1.40 | 4.63 | 6.59 | — |
| Mutant 152 | 4.79 | 9.19 | 13.08 | 14.85 |
| Mutant 154 | 3.76 | 7.66 | 11.85 | 14.38 |

As can be seen from the data shown in Table 48, a number of DAT mutants obtained through GSSM$^{SM}$ evolution showed improved initial rates of monatin formation over the wild type control under the conditions of the assay.

Analysis of GSSM$^{SM}$ DATs in pMet1a

This example describes data demonstrating the enzymatic activity of exemplary polypeptides disclosed herein. Mutant 2, Mutant 6, Mutant 11, Mutant 27, Mutant 40, Mutant 44, Mutant 45, Mutant 58, Mutant 110, Mutant 135, and Mutant 136 were recreated by site directed mutagenesis using QuikChange Multi Site-Directed Mutagenesis Kit (Stratagene, La Jolla, Calif.) according to the manufacturer's instructions. To generate the mutants, the pMET1a tagged construct described in Example 16 (pMET1a:SEQ ID NO:220 (WT)) was used as the template. The mutagenic primers used are listed below in Table 49. The PCR fragments were digested with Dpn1 (Invitrogen, Carlsbad, Calif.) for 1 hour and transformed into *E. coli* Top10 cells (Invitrogen, Carlsbad, Calif.). The resultant purified plasmid preparations were sequenced (Agencourt, Beverly, Mass.) to verify that the correct mutations were incorporated. The plasmids were then transformed into *E. coli* B834(DE3) expression host (Novagen, San Diego, Calif.).

TABLE 49

Primers for Mutagenesis

| Mutant produced | PCR primers | Template |
|---|---|---|
| Mutant 2 | 5'-ATG GAC GCA CTG GGA TGT TAC AAC GGA AAT TGG-3' (SEQ ID NO: 1084)<br>5'-CCA ATT TCC GTT GTA ACA TCC CAG TGC GTC CAT-3' (SEQ ID NO: 1085) | SEQ ID NO: 220 |
| Mutant 6 | 5'-ATG GAC GCA CTG GGA CTT TAC AAC GGA AAT TGG GGG-3' (SEQ ID NO: 1086)<br>5'-CCC CCA ATT TCC GTT GTA AAG TCC CAG TGC GTC CAT-3' (SEQ ID NO: 1087) | SEQ ID NO: 220 |
| Mutant 27 | 5'-TAC CTG GTT TAT TGG CAG GGT ACT CGC GGA ACA GGC CGG-3' (SEQ ID NO: 1088)<br>5'-CCG GCC TGT TCC GCG AGT ACC CTG CCA ATA AAC CAG GTA-3' (SEQ ID NO: 1089) | SEQ ID NO: 220 |
| Mutant 40 | 5'-CTC TGG ATT ATA ATT AAG CCC GGC CAC ATC GAC AAT CTT TAT AG-3' (SEQ ID NO: 1090)<br>5'-CTA TAA AGA TTG TCG ATG TGG CCG GGC TTA ATT ATA ATC CAG AG-3' (SEQ ID NO: 1091) | SEQ ID NO: 220 |
| Mutant 44 | 5'-CTC TGG ATT ATA ATT AAG CCC AGG CAC ATC GAC AAT CTT TAT AG-3' (SEQ ID NO: 1092)<br>5'-CTA TAA AGA TTG TCG ATG TGC CTG GGC TTA ATT ATA ATC CAG AG-3' (SEQ ID NO: 1093) | SEQ ID NO: 220 |
| Mutant 45 | 5'-GTA TTT CCG GCA GGC CCT TCA GCG CTC TGG ATT ATA ATT AAG CC-3' (SEQ ID NO: 1094)<br>5'-GGC TTA ATT ATA ATC CAG AGC GCT GAA GGG CCT GCC GGA AAT AC-3' (SEQ ID NO: 1095) | Mutant 40 |
| Mutant 58 | 5'-CAA TCT TTA TAG AAA AAT CAA GGT TAT TAC CAT GGA TGA TAC CCG C 3' (SEQ ID NO: 1096)<br>5'-GCG GGT ATG ATC CAT GGT AAT AAC CTT GAT TTT TCT ATA AAG ATT G-3' (SEQ ID NO: 1097) | SEQ ID NO: 220 |
| Mutant 110 | 5'-CTT AAC AAA AGA GGA ATT GAA ACT GAC TTT AAA TGA AAT GTA CTC C-3' (SEQ ID NO: 1098)<br>5'-GGA GTA CAT TTC ATT TAA AGT CAG TTT CAA TTC CTC TTT TGT TAA G-3' (SEQ ID NO: 1099) | SEQ ID NO: 220 |
| Mutant 135 | 5'-TTC GAC GCG GAC GAG GTG CTT ACT TCC AGC AGC GGC ACA CTC G-3' (SEQ ID NO: 1100)<br>5'-CGA GTG TGC CGC TGC TGG AAG TAA GCA CCT CGT CCG CGT CGA A-3' (SEQ ID NO: 1101) | SEQ ID NO: 220 |
| Mutant 136 | 5'-TGC TTG TGT CCA GCA GCG GCC GGC TCG GCC TTA GCG CCG-3' (SEQ ID NO: 1102)<br>5'-CGG CGC TAA GGC CGA GCC GGC CGC TGC TGG ACA CAA GCA-3' (SEQ ID NO: 1103) | SEQ ID NO: 220 |

Mutant 2, Mutant 6, Mutant 27, Mutant 40, Mutant 45, Mutant 58, Mutant 110, Mutant 119, Mutant 131, Mutant 135, Mutant 136, Mutant 152, Mutant 154 were generated in the pMET1a vector and transformed into the compatible *E. coli* expression host B834(DE3) (Novagen, San Diego, Calif.) described in Example 2. Overnight cultures in LB medium containing carbenicillin (100 mg/mL) were diluted 1:100 in 100 mL of the same medium and grown in a 500 mL baffled flask. The culture was grown at 30° C. overnight to an $OD_{600nm}$ of 10 in Overnight Express II medium (Solution 1-6, Novagen). Samples for total protein were taken immediately prior to harvesting. Cells were harvested by centrifugation and washed once with 10 mL of potassium phosphate buffer pH 7.8. Cells were immediately frozen at −80° C. until cell extracts were prepared. It is noted that, in addition to site-directed mutagenesis, one skilled in the art can synthesize the genes encoding these D-aminotransferases using multi-change mutagenesis PCR techniques such as those described in Example 25.

Cell extracts were prepared and desalted as described in Example 4 using 100 mM potassium phosphate as the buffer to elute and equilibrate the PD10 column. Total protein and DAT concentrations were determined as described.

Transamination of R,R monatin with pyruvate as the amino acceptor were performed as described in Example 5 except that 15 mM R,R monatin was utilized. Initial analyses of alanine, monatin, and monatin precursor levels identified Mutant 40, Mutant 135 and Mutant 136 as superior mutants resulting in the highest levels of alanine production as shown in Table 50. DAT Mutant 136 appeared to have the highest activity for conversion of R,R monatin to R-MP. The alanine production numbers (in mM) for the various time points are shown in Table 50.

TABLE 50

Alanine formation (mM) from R,R monatin transamination reactions from DATs cloned into pMET1a

| DAT polypeptide | Alanine (mM) 15 minutes | Alanine (mM) 30 minutes | Alanine (mM) 60 minutes | Alanine (mM) 120 minutes |
|---|---|---|---|---|
| wild type control | 3.08 | 5.47 | 8.19 | 10.07 |
| Mutant 2 | 3.38 | 5.74 | 8.85 | 10.52 |
| Mutant 6 | 3.51 | 5.97 | 8.99 | 10.81 |
| Mutant 27 | 4.36 | 8.00 | 10.72 | 10.52 |
| Mutant 40 | 7.89 | 10.37 | 11.79 | 12.50 |
| Mutant 44 | 2.65 | 4.58 | 7.18 | — |
| Mutant 58 | 3.90 | 6.95 | 9.93 | 10.52 |
| Mutant 110 | 3.50 | 6.17 | 9.53 | 10.52 |
| Mutant 135 | 5.35 | 8.64 | 10.82 | 10.91 |
| Mutant 136 | 6.24 | 9.46 | 11.24 | 11.15 |
| Mutant 152 | 4.26 | 7.12 | 9.83 | 10.32 |
| Mutant 154 | 4.16 | 7.13 | 10.07 | 10.76 |

—: not determined under present conditions

To further assess activity, a monatin formation assay was done as described in Example 1 with a DAT concentration of approximately 0.2 mg/mL. As a control, 0.2 mg/mL concentration of purified wild type DAT was evaluated. After 0.5, 1, 2, and 4 hrs, an aliquot was taken and formic acid was added to a final concentration of 2%, and the samples were spun and filtered. Samples were analyzed for monatin using the LC/MS/MS methodology described herein and for tryptophan and alanine using the LC/OPA post-column fluorescence methodology described in Example 36.

TABLE 51

Activity of DATs in pMET1a

| DAT polypeptide | Monatin (mM) 0.50 hr | Monatin (mM) 1.00 hr | Monatin (mM) 2.00 hr | Monatin (mM) 4.00 hr |
|---|---|---|---|---|
| wild type control | 3.96 | 7.83 | 9.70 | 11.18 |
| Mutant 2 | 1.56 | 3.78 | 8.77 | 12.68 |
| Mutant 27 | 4.70 | 9.70 | n.d. | 13.80 |
| Mutant 44 | 3.03 | 5.61 | 8.50 | 12.28 |
| Mutant 45 | 1.40 | 4.00 | 7.70 | 11.50 |
| Mutant 58 | 3.83 | 7.23 | 11.33 | 14.12 |
| Mutant 110 | 2.60 | 5.90 | 9.90 | 12.70 |
| Mutant 119 | 4.12 | 7.87 | 11.37 | 13.50 |
| Mutant 131 | 3.75 | 7.41 | 11.40 | 13.90 |
| Mutant 135 | 6.39 | 10.65 | 13.49 | 13.15 |
| Mutant 136 | 3.36 | 8.02 | 12.86 | 13.16 |
| Mutant 154 | 3.00 | 6.06 | 10.67 | 13.17 |

All the DATs shown in Table 51 produced monatin. DAT mutants Mutant 58, Mutant 135 and Mutant 136 had faster initial rates than the wild type control. Mutant 136 was slower for reaction one (conversion of D-Trp to I13P) but had better overall monatin production than the wild type control.

For the final time point, an additional aliquot was taken (without the addition of formic acid) to determine the stereoisomeric distribution of the monatin produced using the FDAA derivatization methodology described in Example 36. For the select mutants tested, there was little to no impact on stereopurity. In all cases, the mutants produced over 98.8% R,R under the assay conditions tested. These results are shown in Table 52.

TABLE 52

Stereopurities of Monatin Produced by Select Mutants at 4 hours

| DAT polypeptide | % SS | % RS | % RR | % SR |
|---|---|---|---|---|
| wild type (pMet1a) control | 0.00 | 0.40 | 99.30 | 0.20 |
| Mutant 6 | 0.00 | 0.40 | 99.50 | 0.10 |
| Mutant 27 | 0.00 | 0.80 | 98.80 | 0.30 |
| Mutant 40 | 0.00 | 0.20 | 99.80 | 0.00 |
| Mutant 45 | 0.00 | 0.50 | 99.40 | 0.10 |
| Mutant 110 | 0.10 | 0.40 | 99.30 | 0.10 |
| Mutant 135 | 0.00 | 0.40 | 99.50 | 0.10 |
| Mutant 136 | 0.02 | 1.00 | 99.00 | 0.03 |

Example 29

Figure 8:
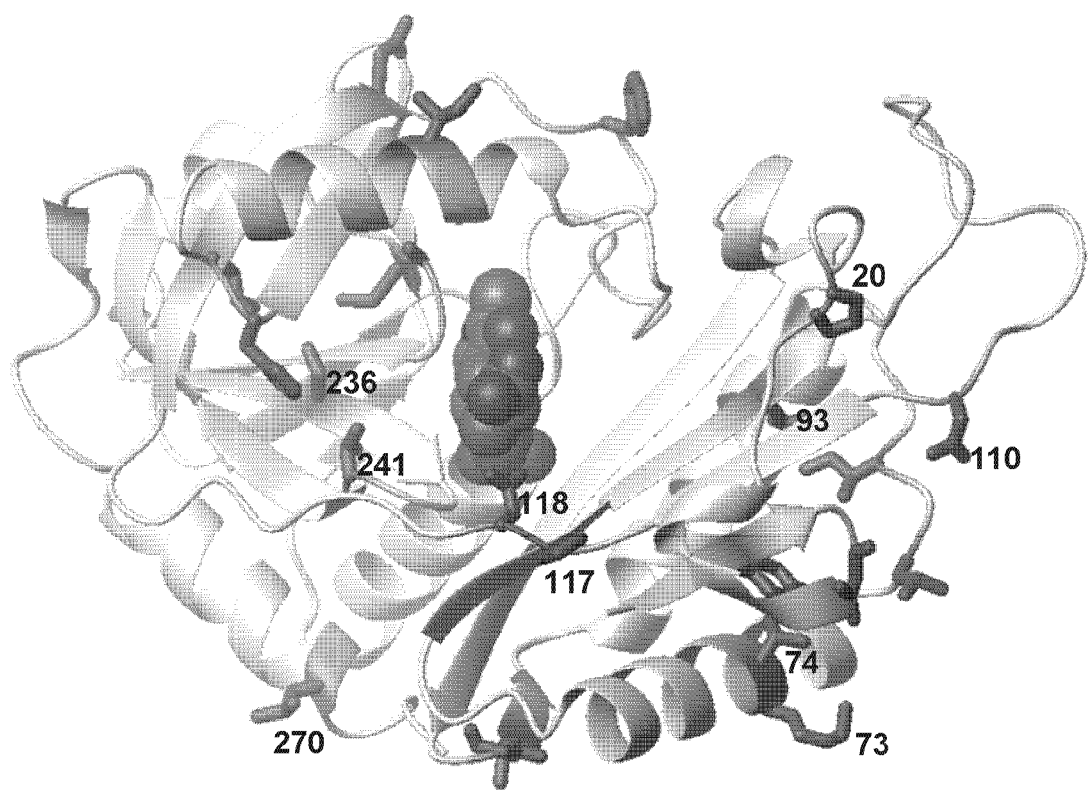
FIG. 8 is a model of 3DAA-D-amino acid aminotransferase, with numbered residues indicating those sites selected for TMCA$^{SM}$ evolution, as described in detail in Example 29, below.

Construction and Testing of Tailored Multi-Site Combinatorial Assembly (TMCA$^{SM}$) Mutants This example describes the construction of exemplary nucleic acids and polypeptides, and describes their enzymatic activity. A subset of GSSM mutations were selected for combination using Tailored Multi-Site Combinatorial Assembly$^{SM}$ (TMCA$^{SM}$) technology. The top ten performers from the GSSM evolution in either the 1 or 15 mM monatin reactions were selected for TMCA$^{SM}$ evolution. The wild-type sequence (SEQ ID NO:220) was threaded onto a model of 3DAA-D-amino acid aminotransferase (FIG. 8). The model in FIG. 8 is shown with pyridoxyl-5'-phosphate D-alanine, with the numbered residues indicating those sites selected for TMCA$^{SM}$ evolution. Table 53 also lists the mutations that were selected for inclusion in the TMCA library. TMCA evolution was performed on wild type (SEQ ID NO:220) and Mutant 45 using the methods described in PCT Application No. PCT/US08/071,771.

TMCA evolution is described in PCT Application Number PCT/US08/071,771 and comprises a method for producing a plurality of progeny polynucleotides having different combinations of various mutations at multiple sites. The method can be performed, in part, by a combination of at least one or more of the following steps:

Obtaining Sequence Information of a ("First" or "Template") Polynucleotide.

For example, the first or template sequence can be a wild type (e.g. SEQ ID NO:220) or mutated (e.g. Mutant 45) sequence. The sequence information can be of the complete polynucleotide (e.g., a gene or an open reading frame) or of partial regions of interest, such as a sequence encoding a site for binding, binding-specificity, catalysis, or substrate-specificity.

Identifying Three or More Mutations of Interest Along the First or Template Polynucleotide sequence.

For example, mutations can be at 3, 4, 5, 6, 8, 10, 12, 20 or more positions within the first or template sequence. The positions can be predetermined by absolute position or by the context of surrounding residues or homology. For TMCA of DAT polypeptides, the top 10 codon changes that resulted in improved enzyme performance were included as mutations of interest. The sequences flanking the mutation positions on either side can be known. Each mutation position may contain two or more mutations, such as for different amino acids. Such mutations can be identified by using Gene Site Saturation Mutagenesis$^{SM}$ (GSSM$^{SM}$) technology, as described herein and in U.S. Pat. Nos. 6,171,820; 6,562,594; and 6,764,835.

Providing Primers (e.g., Synthetic Oligonucleotides) Comprising the Mutations of Interest.

In one embodiment, a primer is provided for each mutation of interest. Thus, a first or template polynucleotide having 3 mutations of interest can use 3 primers at that position. The primer also can be provided as a pool of primers containing a degenerate position so that the mutation of interest is the range of any nucleotide or naturally occurring amino acid, or a subset of that range. For example, a pool of primers can be provided that favor mutations for aliphatic amino acid residues.

The primers can be prepared as forward or reverse primers, or the primers can be prepared as at least one forward primer and at least one reverse primer. When mutations are positioned closely together, it can be convenient to use primers that contain mutations for more than one position or different combinations of mutations at multiple positions.

Providing a Polynucleotide Containing the Template Sequence.

The first or template polynucleotide can be circular, or can be supercoiled, such as a plasmid or vector for cloning, sequencing or expression. The polynucleotide may be single-stranded ("ssDNA"), or can be double-stranded ("dsDNA"). For example, the TCMA method subjects the supercoiled ("sc") dsDNA template to a heating step at 95° C. for 1 min (see Levy, *Nucleic Acid Res.*, 28(12):e57(i-vii) (2000)).

Adding the Primers to the Template Polynucleotide in a Reaction Mixture.

The primers and the template polynucleotide are combined under conditions that allow the primers to anneal to the template polynucleotide. In one embodiment of the TMCA protocol, the primers are added to the polynucleotide in a single reaction mixture, but can be added in multiple reactions.

Performing a Polymerase Extension Reactions.

The extension products (e.g., as a "progeny" or "modified extended polynucleotide") may be amplified by conventional means. The products may be analyzed for length, sequence, desired nucleic acid properties, or expressed as polypeptides. Other analysis methods include in-situ hybridization, sequence screening or expression screening. The analysis can include one or more rounds of screening and selecting for a desired property.

The products can also be transformed into a cell or other expression system, such as a cell-free system. The cell-free system may contain enzymes related to DNA replication, repair, recombination, transcription, or for translation. Exemplary hosts include bacterial, yeast, plant and animal cells and cell lines, and include *E. coli, Pseudomonas fluorescens, Pichia pastoris* and *Aspergillus niger*. For example, XL1-Blue or Stb12 strains of *E. coli* can be used as hosts.

The method of the invention may be used with the same or different primers under different reaction conditions to promote products having different combinations or numbers of mutations.

By performing the exemplary method described above, this protocol also provides one or more polynucleotides produced by this TMCA evolution method, which then can be screened or selected for a desired property. One or more of the progeny polynucleotides can be expressed as polypeptides, and optionally screened or selected for a desired property. Thus, this embodiment of the TMCA evolution protocol provides polynucleotides and the encoded polypeptides, as well as libraries of such polynucleotides encoding such polypeptides. This embodiment of the TMCA evolution protocol further provides for screening the libraries by screening or selecting the library to obtain one or more polynucleotides encoding one or more polypeptides having the desired activity.

Another embodiment of the TMCA evolution protocol described in PCT/US08/071,771 comprises a method of producing a plurality of modified polynucleotides. Such methods generally include (a) adding at least three primers to a double stranded template polynucleotide in a single reaction mixture, wherein the at least three primers are not overlapping, and wherein each of the at least three primers comprise at least one mutation different from the other primers, wherein at least one primer is a forward primer that can anneal to a minus strand of the template and at least one primer is a reverse primer that can anneal to a plus strand of the template, and (b) subjecting the reaction mixture to a polymerase extension reaction to yield a plurality of extended modified polynucleotides from the at least three primers.

Another embodiment of the TMCA evolution protocol described in PCT/US08/071,771 comprises a method wherein a cell is transformed with the plurality of extended products that have not been treated with a ligase. In another embodiment of the invention, the plurality of extended modified polynucleotides is recovered from the cell. In another embodiment, the recovered plurality of extended modified polynucleotides is analyzed, for example, by expressing at least one of the plurality of extended modified polynucleotides and analyzing the polypeptide expressed therefrom. In another embodiment, the plurality of extended modified polynucleotides comprising the mutations of interest is selected.

In another embodiment of the TMCA evolution protocol, sequence information regarding the template polynucleotide is obtained, and three or more mutations of interest along the template polynucleotide can be identified. In another embodiment, products obtained by the polymerase extension can be analyzed before transforming the plurality of extended modified products into a cell.

In one embodiment of the TMCA evolution protocol, products obtained by the polymerase extension are treated with an enzyme, e.g., a restriction enzyme, such as a DpnI restriction enzyme, thereby destroying the template polynucleotide sequence. The treated products can be transformed into a cell, e.g., an *E. coli* cell.

In one embodiment of the TMCA evolution protocol, at least two, or at least three, or at least four, or at least five, or at least six, or at least seven, or at least eight, or at least nine, or at least ten, or at least eleven, or at least twelve, or more primers can be used. In one embodiment, each primer comprises a single point mutation. In another embodiment, two forward or two reverse primers comprise a different change in the same position on the template polynucleotide. In another embodiment, at least one primer comprises at least two changes in different positions on the template polynucleotide. In yet another embodiment, at least one primer comprises at least two changes in different positions and at least two forward or two reverse primers comprise a different change in the same position on the template polynucleotide.

In one embodiment of the TMCA evolution protocol, the forward primers are grouped into a forward group and the reverse primers are grouped into a reverse group, and the primers in the forward group and the primers in the reverse group, independent of one another, are normalized to be equal concentration in the corresponding group regardless of positions on the template polynucleotide, and wherein after the normalization an equal amount of the forward and reverse primers is added to the reaction. In this normalization method, a combination of some positions may be biased. The bias can be due to, for example, a relatively low primer concentration at one position containing a single primer compared to a position containing multiple primers. "Positional bias" refers to resulting polynucleotides which show a strong preference for the incorporation of primers at a single position relative to the other positions within its forward or reverse primer group. This results in a combination of modified polynucleotides which may have a high percentage of mutations within a single primer position but a low percentage of mutations at another position within its forward or reverse primer group. This bias is unfavorable when the goal of the TMCA is to generate progeny polynucleotides comprising all possible combinations of changes to the template. The bias can be corrected, for example, by normalizing the primers as a pool at each position to be equal.

In one embodiment of the TMCA evolution protocol, the primer normalization is performed by organizing the primers into multiple groups depending on their location on the template polynucleotide, wherein the primers covering the same selected region on the template are in one group; normalizing the grouped primers within each group to be equal concentration; pooling the forward primers within one group into a forward group and normalizing concentration between each group of the forward primers to be equal; pooling the reverse primers within one group into a reverse group and normalizing concentration between each group of the reverse primers to be equal; and adding an equal amount of the pooled forward and reversed primers into the reaction. No bias has been observed for position combinations.

In one embodiment of the TMCA evolution protocol, a set of degenerate primers each comprising a degenerate position is provided, wherein the mutation of interest is a range of different nucleotides at the degenerate position. In another embodiment, a set of degenerate primers is provided comprising at least one degenerate codon corresponding to at least one codon of the template polynucleotide and at least one adjacent sequence that is homologous to a sequence adjacent to the codon of the template polynucleotide sequence. In another embodiment, the degenerated codon is N,N,N and encodes any of 20 naturally occurring amino acids. In another embodiment, the degenerate codon encodes less than 20 naturally occurring amino acids.

Another embodiment of the TMCA evolution protocol described in PCT/US08/071771 comprises a method of producing a plurality of modified polynucleotides comprising the mutations of interest. Such methods generally include (a) adding at least two primers to a double stranded template polynucleotide in a single reaction mixture, wherein the at least two primers are not overlapping, and wherein each of the at least two primers comprise at least one mutation different from the other primer(s), wherein at least one primer is a forward primer that can anneal to a minus strand of the template and at least one primer is a reverse primer that can anneal to a plus strand of the template, (b) subjecting the reaction mixture to a polymerase extension reaction to yield a plurality of extended modified polynucleotides from the at least two primers, (c) treating the plurality of extended modified polynucleotides with an enzyme, thereby destroying the template polynucleotide, (d) transforming the treated extended modified polynucleotides that have not been treated with a ligase into a cell, (e) recovering the plurality of extended modified polynucleotides from the cell, and (f) selecting the plurality of extended modified polynucleotides comprising the mutations of interest.

TABLE 53

List of Sites for TMCA evolution

| Mutation | New Codon |
|---|---|
| P20S | AGT |
| K73L | TTG |
| T74V | GTG |
| V93G | GGT |
| N110A | GCT |
| P117W | TGG |
| N118G | GGG |
| N118A | GCG |
| V236T | ACT |
| T241R | CGG |
| L270W | TGG |

TMCA mutants were grown, arrayed, assayed and sequenced using the same method as described for the GSSM evolution in Example 25. Sample performance was compared to the performance of the top candidate from GSSM evolution—Mutant 135—using the same scoring system as described in Example 25. Table 55 lists the TMCA secondary screen hits with unique DNA sequences (TMCA mutants are designated with alphabetic characters to distinguish them from GSSM mutants, which are designated numerically).

TABLE 55

TMCA Mutants Identified as Secondary Screen Hits

| Mutant name | Mutation |
|---|---|
| A | P20S-N118G |
| B | T74V-V93G-L270W |
| C | P20S-T74V-L270W |
| D | T74V-L270W |
| E | P20S-K73L-T241R-L270W |
| F | K73L-V93G-V236T-T241R |
| G | P20S-T74V-V236T |
| H | P20S-K73L-V93G |
| I | K73L-V236T |
| J | P20S-L270W |
| K | 2N-P20S-K73L-V93G-N118G |
| L | P20S-T74V-N118A |
| M | P20S-V236T |
| N | P20S-T241R-L270W |
| O | P20S-T241R |
| P | T74V-V93G-V236T-T241R |
| Q | P20S-K73L-T74V-L270W |
| R | P20S-V93G-V236T |
| S | P20S-K73L-T74V-T241R-L270W |
| T | P20S-K73L-L270W |
| U | T74V-V93G-N118G-V236T-T241R |
| V | P20S-K73L-210A (SILENT-GCC → GCT)-V236T |
| W | N118A-L270W |
| X | P20S-58K (SILENT AAG → AAA)-L270W |
| Y | P20S-V93G-N118G |
| Z | P20S-V236T-T241R |
| AA | P20S-P117W-N118A-V236T-L270W |
| BB | V93G-V236T |
| CC | V236T-L270W |
| DD | P20S-N118G-L270W |
| EE | P20S-N110A-N118G |
| FF | N110A-N118G-T241R-L270W |
| GG | P20S-T74V-V93G-N110A-N118G-V236T-L270W |
| HH | V93G-N110A-N118G-V236T |
| II | P20S-T74V-N110A-N118G |
| JJ | N110A-N118G |

TABLE 55-continued

TMCA Mutants Identified as Secondary Screen Hits

| Mutant name | Mutation |
|---|---|
| KK | P20S-V93G-N110A-N118G-T241R |
| LL | N110A-N118A-L270W |
| MM | P20S-N110A-N118G-L270W |
| NN | N110A-N118A-V236T-T241R |
| OO | N110A-N118G-L270W |
| PP | V93G-N110A-N118G-T241R |
| QQ | P20S-V93G-N110A-N118G |
| RR | V93G-N110A |
| SS | P20S-N110A-N118G-V236T |
| TT | T74V-N110A-N118A-V236T |
| UU | P20S-K73L-T74V-N110A-N118G-V236T-T241R |
| VV | 86E (SILENT GAG → GAA)-N110A-N118A-V236T |
| WW | T74V-N118G |
| XX | P20S-T241R-L270W-277T (SILENT ACA → ACG) |
| YY | T74V-N118A-L270W |
| ZZ | P20S-K73L-N118A-L270W |
| AAA | P20S-V93G-T241R |
| BBB | T74V-V93G-N110A-T241R |
| CCC | V93G-N110A-N118A |
| DDD | P20S-T74V-V93G-N110A-N118G-T241R |
| EEE | T74V-N110A-N118G-L270W |
| FFF | P20S-231A (SILENT GCG → GCA)-V236T |
| GGG | V93G-V236T-T241R |

The samples identified in Table 55 were grown, normalized and assayed in the tertiary screen using the same method as described for the GSSM evolution in Example 26. Monatin and alanine values were determined by LC/MS/MS and compared to a standard curve. Sample performance was compared to the activity of Mutant 135 (the top performer from GSSM evolution). TMCA upmutants identified in the tertiary screen are listed in Table 56.

Example 31

Activity of TMCA Hits

This example describes data demonstrating the enzymatic activity of exemplary polypeptides. Table 56 below shows the activity of the upmutants relative to Mutant 135 at the 15 minute time point in reactions using 1 mM and 15 mM R,R-monatin substrate. Relative activity is the amount of alanine produced by the sample divided by the amount of alanine produced by Mutant 135.

TABLE 56

Activity of TMCA Upmutants in Tertiary Screen

| | | Activity relative to GSSM Mutant 135 | |
|---|---|---|---|
| Mutant | Mutation | Reactions with 1 mM monatin substrate | Reactions with 15 mM monatin substrate |
| C | P20S-T74V-L270W | 1.02 | 0.93 |
| E | P20S-K73L-T241R-L270W | 1.32 | 1.31 |
| F | K73L-V93G-V236T-T241R | 1.29 | 0.64 |
| G | P20S-T74V-V236T | 1.28 | 1.30 |
| I | K73L-V236T | 1.24 | 1.29 |
| J | P20S-L270W | 0.79 | 1.01 |
| L | P20S-T74V-N118A | 1.62 | 0.83 |
| M | P20S-V236T | 1.27 | 1.46 |
| O | P20S-T241R | 1.33 | 1.71 |
| R | P20S-V93G-V236T | 1.22 | 1.02 |
| S | P20S-K73L-T74V-T241R-L270W | 1.16 | 1.18 |
| V | P20S-K73L-210A (SILENT-GCC → GCT)-V236T | 1.03 | 1.00 |
| Z | P20S-V236T-T241R | 1.02 | 0.89 |
| BB | V93G-V236T | 1.55 | 1.98 |
| CC | V236T-L270W | 1.24 | 1.40 |
| DD | P20S-N118G-L270W | 1.54 | 1.78 |
| PP | V93G-N110A-N118G-T241R | 1.40 | 1.53 |
| TT | T74V-N110A-N118A-V236T | 1.10 | 0.42 |
| VV | 86E (SILENT GAG → GAA)-N110A-N118A-V236T | 1.31 | 0.52 |
| WW | T74V-N118G | 1.23 | 1.49 |
| YY | T74V-N118A-L270W | 1.97 | 1.30 |
| ZZ | P20S-K73L-N118A-L270W | 1.01 | 0.44 |
| AAA | P20S-V93G-T241R | 1.86 | 3.49 |
| CCC | V93G-N110A-N118A | 1.26 | 0.56 |

Several samples were identified that outperformed Mutant 135 under the conditions tested. Potential $K_m$ and $V_{max}$ upmutants were identified. The results of the GSSM and TMCA evolutions indicate that wild type SEQ ID NO:220 is further evolvable for increased specific activity on monatin.

Example 32

Evaluation of TMCA Mutant DATs in pMET1a

This example describes data demonstrating the enzymatic activity of exemplary polypeptides disclosed herein. Mutant E, Mutant G, Mutant I, Mutant M, Mutant O, Mutant P, Mutant BB, Mutant PP, Mutant WW, and Mutant AAA (DATs created using TMCA technology, see Examples 29 and 30) were recreated by site-directed mutagenesis using QuikChange Multi Site-Directed Mutagenesis Kit (Stratagene, La Jolla, Calif.) according to the manufacturer's instructions. To generate the mutants, pMET1a tagged constructs described in Example 16 and Example 28 were used as templates. The mutagenic primers used are listed below in Table 57. The PCR fragments were digested with Dpn1 (Invitrogen, Carlsbad, Calif.) for 1 hour and transformed into E. coli XL10-Gold cells (Stratagene, La Jolla, Calif.). The resultant purified plasmid preparations were sequenced (Agencourt, Beverly, Mass.) to verify that the correct mutations were incorporated. The plasmids were then transformed into E. coli B834(DE3) expression host (Novagen, San Diego, Calif.).

TABLE 57

Primers for Mutants in pMET1a Vector

| TMCA mutant polypeptide produced | PCR primers | Template |
|---|---|---|
| Mutant E | 5'-CTG GAC GAG ATG ACT GTG AGT ATG AAC GAC AGG GGC TGC TAC-3' (SEQ ID NO: 1104)<br>5'-TGC TTG TGT CCA GCA GCG GCC GGC TCG GCC TTA GCG CCG-3' (SEQ ID NO: 1105)<br>5'CTA AAA AAA ATC CAG GAT GAA GTG TGG AGG GAA TTT ATC GAA GCG ACA GG3' (SEQ ID NO: 1106) | Mutant 110 |
| Mutant G | 5'-CAA AAG AGG AAT TGA AAA AGT GTT AA ATG AAA TGT ACT CC-3' (SEQ ID NO: 1107)<br>5'-GGA GTA CAT TTC ATT TAA CAC TTT TTT CAA TTC CTC TTT TG-3' (SEQ ID NO: 1108) | Mutant M |
| Mutant I | 5'-CTT AAC AAA AGA GGA ATT GAA ACT GAC TTT AAA TGA AAT GTA CTC C-3' (SEQ ID NO: 1109)<br>5'-GGA GTA CAT TTC ATT TAA AGT CAG TTT CAA TTC CTC TTT TGT TAA G-3' (SEQ ID NO: 1110) | Mutant 135 |
| Mutant M | 5'-CTG GAC GAG ATG ACT GTG AGT ATG AAC GAC AGG GGC TGC TAC-3' (SEQ ID NO: 1111)<br>5'-GTA GCA GCC CCT GTC GTT CAT ACT CAC AGT CAT CTC GTC CAG-3' (SEQ ID NO: 1112) | Mutant 135 |
| Mutant O | 5'-CTG GAC GAG ATG ACT GTG AGT ATG AAC GAC AGG GGC TGC TAC-3' (SEQ ID NO: 1113)<br>5'-GTA GCA GCC CCT GTC GTT CAT ACT CAC AGT CAT CTC GTC CAG-3' (SEQ ID NO: 1114) | Mutant 136 |
| Mutant P | 5'-CAA AAG AGG AAT TGA AAA AGT GTT AA ATG AAA TGT ACT CC-3' (SEQ ID NO: 1115)<br>5'-TTC GAC GCG GAC GAG GTG CTT ACT TCC AGC AGC GGC ACA CTC G-3' (SEQ ID NO: 1116)<br>5'-TGC TTG TGT CCA GCA GCG GCC GGC TCG GCC TTA GCG CCG-3' (SEQ ID NO: 1117) | Mutant 27 |
| Mutant BB | 5'-TAC CTG GTT TAT TGG CAG GGT ACT CGC GGA ACA GGC GG-3' (SEQ ID NO: 1118)<br>5'-CCG GCC TGT TCC GCG AGT ACC CTG CCA ATA AAC CAG GTA-3' (SEQ ID NO: 1119) | Mutant 135 |
| Mutant PP | 5'-TAC CTG GTT TAT TGG CAG GGT ACT CGC GGA ACA GGC GG-3' (SEQ ID NO: 1120)<br>5'-TGC TTG TGT CCA GCA GCG GCC GGC TCG GCC TTA GCG CCG-3' (SEQ ID NO: 1121) | Mutant 45 |
| Mutant WW | 5'-CAA AAG AGG AAT TGA AAA AGT GTT AA ATG AAA TGT ACT CC-3' (SEQ ID NO: 1122)<br>5'-GGA GTA CAT TTC ATT TAA CAC TTT TTT CAA TTC CTC TTT TG-3' (SEQ ID NO: 1123) | Mutant M |
| Mutant AAA | 5'-CTG GAC GAG ATG ACT GTG AGT ATG AAC GAC AGG GGC TGC TAC-3' (SEQ ID NO: 1124)<br>5'-TGC TTG TGT CCA GCA GCG GCC GGC TCG GCC TTA GCG CCG-3' (SEQ ID NO: 1125) | Mutant 27 |

*E. coli* B834(DE3) (Novagen, San Diego, Calif.) cultures expressing carboxy-terminal His-tagged Mutant 110, Mutant 135, Mutant 136, Mutant E, Mutant G, Mutant I, Mutant M, Mutant O, Mutant P, Mutant BB, Mutant PP, Mutant WW, Mutant AAA and wild type (SEQ ID NO:220) proteins were grown in 200 mL of Overnight Express II medium (Solution 1-6, Novagen) in a 500 mL baffled flask overnight at 30° C. to an $OD_{600}$ of 10. Samples for total protein were taken immediately prior to harvesting. Cells were harvested by centrifugation and immediately frozen at −80° C. until cell extracts were prepared as described in Example 4.

Cell extracts were created by the addition of 50 mL of Bug Buster Primary Amine Free (Novagen, San Diego, Calif.) with 50 µl of Benzonase Nuclease (Novagen, San Diego, Calif.), 0.75 µl of rLysozyme (Novagen, San Diego, Calif.), and 250 µl of Protease Inhibitor Cocktail II (Calbiochem, San Diego, Calif.). The cells were incubated for 15 minutes at room temperature with gentle rocking. The extracts were centrifuged at 45,000×g for 10 minutes.

His-tagged proteins were purified as described in Example 4 using GE Healthcare (Piscataway, N.J.) Chelating Sepharose™ Fast Flow resin. The exception was Mutant 182, which was analyzed as CFE as described in Example 4. Purified protein was desalted using a PD10 column into 100 mM potassium phosphate, pH 7.8 with 0.050 mM PLP. Total protein and DAT concentrations were determined as described in Example 4.

A 3-step monatin formation assay was done as described in Example 5 with a DAT concentration of approximately 0.2 mg/mL and the aldolase at a concentration of 0.1 mg/mL. As a control, 0.2 mg/mL concentration of purified wild type DAT (SEQ ID NO:220) was evaluated. After 0.5, 1, 2, 4 and 24 hours, an aliquot was taken, formic acid was added to a final concentration of 2% and the samples were spun and filtered. Samples were analyzed for monatin using LC/MS/MS methodology and for tryptophan and alanine using the LC/OPA post-column fluorescence methodology described in Example 36. At the last time point, an additional aliquot was taken (without pH adjustment) to determine % R,R monatin by the FDAA-derivatization method described in Example 36. The amount of monatin (mM) produced at various time points can be found in Table 58. Stereopurity was also determined and the percent of the R,R stereoisomer can be found in the far right hand column. The stereoisomer R,S made up the majority of the balance.

TABLE 58

Activity of Select DAT Mutants

| DAT polypeptide | Monatin (mM) 0.25 hr | Monatin (mM) 0.5 hr | Monatin (mM) 1 hr | Monatin (mM) 4 hr | % RR |
|---|---|---|---|---|---|
| Wild type control (SEQ ID NO: 220) | 1.60 (±0.42) | 2.95 (±0.64) | 5.00 (±0.85) | 11.40 (±0.42) | 99.50 (±0.08) |
| Mutant 110 | 1.70 (±0.00) | 3.20 (±0.85) | 5.75 (±0.21) | 12.60 (±0.14) | 99.48 (±0.32) |
| Mutant 135 | 3.65 (±0.35) | 6.17 (±0.65) | 10.33 (±0.32) | 13.20 (±0.56) | 99.42 (±0.11) |
| Mutant 136 | 2.60 | 5.00 | 8.10 | 12.90 | 98.98 |
| Mutant 182 | — | 3.20 | 6.80 | 14.30 | 99.50 |
| Mutant E | 1.80 | 3.80 | 8.60 | 18.60 | 99.45 |
| Mutant G | 3.10 | 6.50 | 9.90 | 12.90 | 99.05 |
| Mutant I | 2.90 | 5.30 | 8.50 | 12.90 | 99.46 |
| Mutant M | 4.20 | 8.10 | 11.20 | 13.80 | 98.96 |
| Mutant O | 2.60 | 5.70 | 9.50 | 14.00 | 98.59 |
| Mutant BB | 4.20 | 8.20 | 11.40 | 13.70 | 98.97 |
| Mutant PP | 2.40 | 3.20 | 6.20 | 17.40 | 97.25 |
| Mutant AAA | 2.80 | 6.80 | 11.80 | 14.80 | 97.98 |

— = not determined under conditions tested

The relative rates of monatin production under the conditions tested indicate the greatest improvement in initial activity from Mutant 135, Mutant 136, Mutant E, Mutant G, Mutant M, Mutant O, Mutant BB, and Mutant AAA as determined by comparing the rate of monatin formation with purified protein over the first hour between the mutants and the wild type control (SEQ ID NO:220) DAT. DATs Mutant E and Mutant AAA had high activity but were not well expressed (less than 5% of the total protein) nor very soluble under the conditions tested.

The assay samples were also analyzed for intermediates such as monatin precursor, I3P, and byproduct 4-hydroxy-4-methyl glutmatic acid (HMG) as described in Example 36. The analysis of the amount of HMG formed was determined for the mutants Mutant E, Mutant G, Mutant I, Mutant M, Mutant O, Mutant BB, Mutant PP, Mutant AAA and Mutant 110, Mutant 135, and Mutant 136. It appears that at the 4 hour time point, more HMG were formed by the mutants Mutant 135, Mutant G, Mutant I, Mutant M and Mutant BB. These mutants all contained the change V236T. HMG was also present above the levels of the wild type control (SEQ ID NO:220) with mutants Mutant E, Mutant G, Mutant M and Mutant AAA likely due to the change in residue P20S.

TABLE 59

HMG Formation by DAT Mutants after 4 hours

| DAT polypeptide | HMG (mM) 4 hr |
|---|---|
| Wild type control (SEQ ID NO: 220) | nd |
| Mutant 110 | nd |
| Mutant 135 | 1.0 |
| Mutant 136 | nd |
| Mutant E | 0.2 |
| Mutant G | 1.6 |
| Mutant I | 0.8 |
| Mutant M | 1.6 |
| Mutant O | nd |
| Mutant BB | 1.5 |
| Mutant AAA | 0.6 | nd = not detected

DAT Assay Monitoring I3P Formation

The formation of I3P from tryptophan was detected and monitored at a wavelength of 340 nm. Reactions were carried out in 1 mL reaction volume containing 900 µL of a 25 mM D-tryptophan, 25 mM pyruvic acid sodium salt, 0.05 mM PLP, 100 mM potassium phosphate (pH 7.8) solution combined with 100 µL dilutions of DAT (total protein) prepared as described above. Enzymes were diluted 1:100 and 1:200 with cold 50 mM potassium phosphate (pH 7.8) and 50 µM PLP prior to addition to the assay. Enzyme was added to the reaction mixture 1:100 and monitored in increments of 15 seconds for 3 minutes. The formation of indole-3-pyruvate (I3P) was monitored at a wavelength of 340 nm for 3 minutes on a BioRad Spectrophotometer (GE Healthscience, Piscataway, N.J.) and rates were measured within the dynamic range of a standard curve. The standard curve was generated with purified wild type (SEQ ID NO:220) DAT protein and the concentration of DAT in cell extract was determined based on the equation of the line for the standard curve. The effective concentration of DAT with respect to the wild type DAT for the first reaction is reported in Table 60.

TABLE 60

Activity of DAT (Conversion of Tryptophan to I3P)

| DAT Polypeptide | Rate of I3P formation (Δ Abs340 nm/ minute) | Concentration of DAT (determined by activity) mg/mL | Activity relative to wild type for first reaction |
|---|---|---|---|
| Wild type control (SEQ ID NO: 220) | 0.058 | 0.065 | 1.0 |
| Mutant 135 | 0.067 | 0.075 | 1.2 |
| Mutant 136 | 0.017 | 0.019 | 0.3 |
| Mutant E | 0.000 | 0.002 | 0.1 |
| Mutant G | 0.027 | 0.030 | 0.5 |
| Mutant M | 0.050 | 0.055 | 0.9 |
| Mutant O | 0.031 | 0.033 | 0.8 |
| Mutant BB | 0.045 | 0.050 | 0.8 |
| Mutant AAA | 0.002 | 0.004 | 0.2 |

The wild type DAT (SEQ ID NO:220) and mutants 136, E, G, M, O, BB and AAA can facilitate the conversion of both tryptophan to I3P and of monatin precursor to monatin. Table 60 shows that these mutants had lower activity for the conversion of tryptophan to I3P relative to the wild type DAT (SEQ ID NO:220). Yet, according to Table 58, the same mutants produced more total monatin from tryptophan than did the wild type DAT (SEQ ID NO:220). Thus, under the conditions of the assay described herein, there appears to be a beneficial effect on monatin production through controlling the conversion of tryptophan to I3P in the monatin biosynthetic pathway. For example, although Mutant E showed the lowest relative activity for conversion of tryptophan to I3P (see Table 60), it also produced the highest amount of monatin at 4 hours (see Table 58). Without being bound by theory, the beneficial effects of controlling the first step in the reaction could be attributed to a reduction of I3P buildup and subsequent potential I3P degradation to products other than monatin. Generally, it also appears that controlling the rate of one or more of the reactions involved in the production of monatin from tryptophan, using, for example, one or more mutant DATs, can have a beneficial effect on the total amount of monatin produced.

Example 33

Evaluation of Mutant DATs at 35° C.

This example describes data demonstrating the enzymatic activity of exemplary polypeptides disclosed herein. Starter cultures were grown overnight at 37° C. with shaking at 250 rpm until the $OD_{600nm}$ reached 0.05. 200 mL of Overnight Express II medium (Novagen, San Diego, Calif.) was inoculated and grown as described in Example 3. Cultures were grown in duplicate and the cell pellets were combined. The pellets were resuspended in 40 mL of 50 mM sodium phosphate buffer (pH 7.8) with 0.05 mM PLP and lysed using a French Press (Sim Aminco, Rochester, N.Y.) per the manufacturer's instructions. The supernatant was collected in a clean tube and stored at −80° C. until used.

A 3-step monatin formation assay was performed as described in the methods with a DAT concentration of approximately 0.2 mg/mL and the aldolase at a concentration of 0.1 mg/mL in glass vials. Duplicate samples were incubated at either 25° C. or 35° C. and after 1, 3, and 4 hours, an aliquot was taken and formic acid was added to a final concentration of 2%, and the samples were spun and filtered. Samples were analyzed for monatin using LC/MS/MS methodology and for tryptophan and alanine using the LC/OPA post-column fluorescence methodology described in Example 36. Samples were also analyzed for intermediates such as monatin precursor, I3P, and 4-hydroxy-4-methyl glutmatic acid (HMG) as described in Example 36. The amount of monatin (mM) produced at various time points is shown in Table 61.

The monatin formation assay was repeated for the wild type control (SEQ ID NO:220), Mutant 135 and Mutant M under similar conditions except the reactions were carried out in plastic vials. Monatin production at various time points can be found in Table 61.

TABLE 61

Monatin Formation at 25° C. and 35° C.

| DAT polypeptide | Monatin (mM) 1 hr | Monatin (mM) 3 hr | Monatin (mM) 4 hr |
|---|---|---|---|
| 25° C. | | | |
| wild type control (pMet1a) | 2.0 | 6.8 | 8.4 |
| Mutant 135 (V236T) | 10.0 | 14.4 | 14.2 |
| Mutant 136 (241R) | 4.0 | 10.8 | 12.4 |
| Mutant E (20S, 73L, 241R, 270W) | 0.8 | 4.2 | 5.6 |
| Mutant M (20S, 236T) | 10.0 | 13.4 | 14.2 |
| Mutant O (20S, 241R) | 8.0 | 13.8 | 13.6 |
| Mutant BB (93G, 236T) | 4.0 | 11.4 | 12.4 |
| Mutant AAA (20S, 93G, 241R) | 0.2 | 1.0 | 1.6 |
| 35° C. | | | |
| wild type control (pMet1a) | 2.2 | 5.4 | 6.2 |
| Mutant 135 (V236T) | 9.4 | 9.2 | 9.8 |
| Mutant 136 (241R) | 4.8 | 9.4 | 10.4 |
| Mutant E (20S, 73L, 241R, 270W) | 0.6 | 3.4 | 4.2 |
| Mutant M (20S, 236T) | 9.2 | 13.6 | 14.6 |
| Mutant O (20S, 241R) | 9.6 | 10.6 | 10.8 |
| Mutant BB (93G, 236T) | 4.6 | 9.0 | 9.2 |
| Mutant AAA (20S, 93G, 241R) | 0.2 | 1.6 | 2.2 |

Lower monatin titers were observed using the DAT enzymes described here at 35° C. under the conditions of the assay. However, select mutants Mutant 135, Mutant 136, Mutant M, Mutant 0 and Mutant BB showed increased initial monatin production rates and greater 4 hour monatin titers than the wild type control (SEQ ID NO:220) at 35° C. under the assay conditions.

Example 34

Evaluation of Mutant DATs in BioReactors

This example describes data demonstrating the enzymatic activity of exemplary polypeptides disclosed herein in bioreactors. Glycerol stocks of the wild type control (SEQ ID NO:220), Mutant 135, Mutant 136, Mutant M, Mutant O, and Mutant BB were used to streak plates for single colonies. Single colonies were used to inoculate flasks containing 5 mL of LB medium with the appropriate antibiotic. The starter cultures were grown overnight at 37° C. with shaking at 250 rpm and the $OD_{600nm}$ was checked. When the $OD_{600nm}$ reached 0.05, the 5 mL culture was inoculated into a 200 mL of Overnight Express II medium (Novagen, San Diego, Calif.) and then incubated at 30° C. with shaking at 250 rpm. Each culture was grown in duplicate and the cell pellets were combined. Cultures were harvested by pelleting cells by centrifugation at 4000 rpm for 15 minutes. The supernatant was poured off and the pellet was either frozen for later use or resuspended in 40 mL of 50 mM sodium phosphate buffer (pH 7.8) and lysed using a French Press (Sim Aminco, Rochester, N.Y.) or a microfluidizer (Microfluidics Corporation, Newton, Mass.) per the manufacturer's instructions. The supernatant was collected in a clean tube and stored at −80° C. until used. Approximately 1 mL of the clarified lysate was retained for protein quantitation using the BCA assay (Pierce, Rockford, Ill.) and SDS-PAGE analysis.

Bench scale reactions (250 mL) were carried out in 0.7 L Sixfors agitated fermentors (Infors AG, Bottmingen, Switzerland) under a nitrogen headspace as described in Example 15. The reaction mix contained 10 mM potassium phosphate, 1 mM $MgCl_2$, 0.05 mM PLP, 200 mM sodium pyruvate and 130 mM D-tryptophan. The reaction mix was adjusted to 25° C. and adjusted to pH 7.8 with potassium hydroxide. The aldolase described in Example 6 was added as a clarified cell extract at 0.02 mg/mL of target protein. Wild type control (SEQ ID NO:220), Mutant 135, Mutant 136, Mutant M, Mutant O, and Mutant BB DATs have soluble protein expressions ranging from 15-35% based on visual estimation. The clarified cell extracts were added at 0.20 mg/mL of target protein.

The progress of the reactions was followed by measuring monatin production at 1, 2, 4 and 24 hours using the LC/MS/MS methodology described in Example 36. The results are shown in Table 62.

TABLE 62

Monatin Production in Fermentors

| DAT polypeptide | Protein Expression | Monatin (mM) 1 hr | Monatin (mM) 2 hr | Monatin (mM) 4 hr | Monatin (mM) 24 hr |
|---|---|---|---|---|---|
| wild type control | 25% | 0.90 | 2.80 | 12.40 | 12.80 |
| Mutant 135 | 30% | 0.50 | 8.80 | 12.40 | 12.40 |
| Mutant 136 | 35% | 3.80 | 7.80 | 11.60 | 12.80 |
| Mutant M | 15% | 3.40 | 6.80 | 12.10 | 12.20 |
| Mutant O | 15% | 5.20 | 8.60 | 10.90 | 9.80 |
| Mutant BB | 15% | 3.40 | 6.20 | 10.50 | 12.60 |

The initial rate of monatin production observed with mutants Mutant 136, Mutant M, Mutant O, and Mutant BB was faster than the rate with the wild type control (SEQ ID NO:220). All the mutants showed improved monatin formation at 2 hours under the conditions tested. The lower than expected monatin titer at 1 hour for Mutant 135 was attributed to the inadvertent exposure to oxygen during the first hour. After 4 hours, the monatin titer was comparable between the mutants and the control under the conditions tested.

Example 35

Evaluation of the Impact of Temperature on Mutant DATs in BioReactors

This example describes data demonstrating the enzymatic activity of exemplary polypeptides disclosed herein under different temperature conditions. The wild type control (SEQ ID NO:220), Mutant 135 and Mutant M were produced in a fermentor at the 2.5 L scale as described in Example 15. At the end of fermentation, the cells were harvested by centrifugation at 5000-7000×g for 10 minutes and frozen as a wet cell paste at −80° C.

To prepare cell free extract containing the wild type control, Mutant 135 and Mutant M D-aminotransferases, 50 g of wet cell paste was suspended in 150 mL of 50 mM potassium phosphate buffer (pH 7.8) containing 0.05 mM pyridoxal phosphate (PLP) and then disrupted using a Microfluidics homogenizer (Microfluidics, Newton, Mass.) (3 passes at 18,000 psi), maintaining the temperature of the suspension at less than 15° C. Cellular debris was removed by centrifugation (20,000×g for 30 minutes).

The rate of formation of I3P from tryptophan was monitored at 340 nm for three minutes as described in Example 32. The concentration of the wild type control was determined to be 6.8 mg/mL, the concentration of Mutant 135 was determined to be 7.0 mg/mL and Mutant M was determined to be 5.6 mg/mL based on a standard curve generated with purified DAT wild type control. The DAT concentrations determined by I3P formation were used to dose the Infors to 0.2 mg/mL DAT. The aldolase was added as a cell free extract at 0.02 mg/mL aldolase. The reaction mix contained 10 mM potassium phosphate, 1 mM $MgCl_2$, 0.05 mM PLP, 200 mM sodium pyruvate and 130 mM D-tryptophan under a nitrogen headspace. Each of the DATs was evaluated for monatin production in a bioreactor at 35° C. and at 25° C.

Samples were taken at 0.5, 1, 3, 4 and 24 hours and analyzed using the LC/MS/MS methodology described in Example 36. The results are shown in Table 63.

TABLE 63

Fermenters at 25° and 35° C.

| DAT polypeptide | Monatin (mM) 0.5 hr | Monatin (mM) 1 hr | Monatin (mM) 3 hr | Monatin (mM) 4 hr | Monatin (mM) 24 hr |
|---|---|---|---|---|---|
| 25° C. | | | | | |
| Wild type control (SEQ ID NO: 220) | 0.9 | 2.4 | 5.6 | 7.9 | 19.1 |
| Mutant 135 | 1.6 | 4.4 | 10.9 | 12.1 | 18.6 |
| Mutant M | 2.1 | 4.5 | 9.4 | 12.4 | 17.4 |
| 35° C. | | | | | |
| Wild type control (SEQ ID NO: 220) | 2.3 | 3.9 | 6.5 | 7.9 | 10.7 |
| Mutant 135 | 4.1 | 6.1 | 9.8 | 11.5 | 14.9 |
| Mutant M | 4.1 | 6.3 | 9.9 | 11.3 | 14.9 |

As seen in Example 34, select mutant DATs yielded higher monatin titers at 35° C. compared to the wild type control DAT (SEQ ID NO:220). The wild type control DAT had a slower initial rate of monatin production but a higher final titer at 25° C. under the conditions tested. Both mutants Mutant 135 and Mutant M showed improved activity over the wild type control at 25° C. and 35° C. Mutants Mutant 135 and Mutant M had both a higher initial rate of monatin production and a higher final titer at 35° C. compared to the control under the conditions tested. The selected mutants were more stable than the wild type control at the higher temperatures. This indicates the advantages of GSSM and TMCA technologies in producing mutants with greater thermostability than the wild type control. One skilled in the arts could screen these GSSM or TMCA libraries for mutants with, for example, increased temperature tolerance.

Example 36

Detection of Monatin, MP, Tryptophan, Alanine, and HMG

This example describes the analytical methodology associated with the further characterization of exemplary D-aminotransferase (DAT) enzymes disclosed herein.

UPLC/UV Analysis of Monatin and Tryptophan

Analyses of mixtures for monatin and tryptophan derived from biochemical reactions were performed using a Waters Acquity UPLC instrument including a Waters Acquity PhotoDiode Array (PDA) absorbance monitor. UPLC separations were made using an Agilent XDB C8 1.8 μm 2.1×100 mm column (part #928700-906) (Milford, Mass.) at 23° C. The UPLC mobile phase consisted of A) water containing 0.1% formic acid B) acetonitrile containing 0.1% formic acid.

The gradient elution was linear from 5% B to 40% B, 0-4 minutes, linear from 40% B, to 90% B, 4-4.2 minutes, isocratic from 90% B to 90% B, 4.2-5.2 minutes, linear from 90% B to 5% B, 5.2-5.3 minutes, with a 1.2 minute re-equilibration period between runs. The flow rate was 0.5 mL/min, and PDA absorbance was monitored at 280 nm. Sample concentrations are calculated from a linear least squares calibration of peak area at 280 nm to known concentration, with a minimum coefficient of determination of 99.9%.

Derivatization of Monatin Intermediates (Indole-3-Pyruvic Acid (I3P), Hydroxymethyloxyglutaric Acid, Monatin Precursor, and Pyruvate) with O-(4-Nitrobenzyl)hydroxylamine hydrochloride (NBHA)

In the process of monatin production, various intermediate compounds are formed and utilized. These compounds include: Indole-3-Pyruvic Acid (I3P), Hydroxymethyloxyglutaric Acid, Monatin Precursor, and Pyruvate. The ketone functional group on these compounds can be derivatized with O-(4-Nitrobenzyl)hydroxylamine hydrochloride (NBHA).

To 20 µL of sample or standard, 140 µL of NBHA (40 mg/mL in pyridine) was added in an amber vial. Samples were sonicated for 15 min in the presence of heat with occasional mixing. A 1:3 dilution in 35% Acetonitrile in water was performed.

UPLC/UV Analysis of Monatin Intermediates (Indole-3-Pyruvic Acid, Hydroxymethyloxyglutaric Acid, Monatin Precursor, and Pyruvate)

A Waters Acquity UPLC instrument including a Waters Acquity Photo-Diode Array (PDA) absorbance monitor (Waters, Milford, Mass.) was used for the analysis of the intermediate compounds. UPLC separations were made using a Waters Acquity HSS T3 1.8 mm×150 mm column (Waters, Milford, Mass.) at 50° C. The UPLC mobile phase consisted of A) water containing 0.3% formic acid and 10 mM ammonium formate and B) 50/50 acetonitrile/methanol containing 0.3% formic acid and 10 mM ammonium formate.

The gradient elution was linear from 5% B to 40% B, 0-1.5 minutes, linear from 40% B, to 50% B, 1.5-4.5 minutes, linear from 50% B to 90% B, 4.5-7.5 minutes, linear from 90% B to 95% B, 7.5-10.5 minutes, with a 3 minute re-equilibration period between runs. The flow rate was 0.15 mL/min from 0-7.5 minutes, 0.18 mL/min from 7.5-10.5 minutes, 0.19 mL/min from 10.5-11 minutes, and 0.15 mL/min from 11-13.5 minutes. PDA absorbance was monitored at 270 nm.

Sample concentrations were calculated from a linear least squares calibration of peak area at 270 nm to known concentration, with a minimum coefficient of determination of 99.9%.

Chiral LC/MS/MS (MRM) Measurement of Monatin

Determination of the stereoisomer distribution of monatin in biochemical reactions was accomplished by derivatization with 1-fluoro-2-4-dinitrophenyl-5-L-alanine amide (FDAA), followed by reversed-phase LC/MS/MS MRM measurement.

Derivatization of Monatin with FDAA

100 µL of a 1% solution of FDAA in acetone was added to 50 µL of sample or standard. Twenty µL of 1.0 M sodium bicarbonate was added, and the mixture was incubated for 1 hour at 40° C. with occasional mixing. The sample was removed and cooled, and neutralized with 20 µL of 2.0 M HCl (more HCl may be required to effect neutralization of a buffered biological mixture). Samples were analyzed by LC/MS/MS.

LC/MS/MS Multiple Reaction Monitoring for the Determination of the Stereoisomer Distribution of Monatin Analyses were performed using the Waters/Micromass® liquid chromatography-tandem mass spectrometry (LC/MS/MS) instrument including a Waters 2795 liquid chromatograph with a Waters 996 Photo-Diode Array (PDA) absorbance monitor (Waters, Milford, Mass.) placed in series between the chromatograph and a Micromass® Quattro Ultima® triple quadrupole mass spectrometer. The LC separations capable of separating all four stereoisomers of monatin (specifically FDAA-monatin) were performed on a Phenomenex Luna® 2.0×250 mm (3 µm) C18 reversed phase chromatography column at 40° C. The LC mobile phase consisted of A) water containing 0.05% (mass/volume) ammonium acetate and B) acetonitrile. The elution was isocratic at 13% B, 0-2 minutes, linear from 13% B to 30% B, 2-15 minutes, linear from 30% B to 80% B, 15-16 minutes, isocratic at 80% B 16-21 minutes, and linear from 80% B to 13% B, 21-22 minutes, with a 8 minute re-equilibration period between runs. The flow rate was 0.23 mL/min, and PDA absorbance was monitored from 200 nm to 400 nm. All parameters of the ESI-MS were optimized and selected based on generation of deprotonated 20 molecular ions ([M−H]−) of FDAA-monatin, and production of characteristic fragment ions. The following instrumental parameters were used for LC/MS analysis of monatin in the negative ion ESI/MS mode: Capillary: 3.0 kV; Cone: 40 V; Hex 1: 15 V; Aperture: 0.1 V; Hex 2: 0.1 V; Source temperature: 120° C.; Desolvation temperature: 350° C.; Desolvation gas: 662 L/h; Cone gas: 42 L/h; Low mass resolution (Q1): 14.0; High mass resolution (Q1): 15.0; Ion energy: 0.5; Entrance: 0 V; Collision Energy: 20; Exit: 0 V; Low mass resolution (Q2): 15; High mass resolution (Q2): 14; Ion energy (Q2): 2.0; Multiplier: 650. Three FDAA-monatin-specific parent-to-daughter transitions were used to specifically detect FDAA-monatin in in vitro and in vivo reactions. The transitions monitored for monatin were 542.97 to 267.94, 542.97 to 499.07, and 542.97 to 525.04. Identification of FDAA-monatin stereoisomers was based on chromatographic retention time as compared to purified monatin stereoisomers, and mass spectral data.

Liquid Chromatography-Post Column Derivatization with OPA, Fluorescence Detection of Amino Acids, Including: Hydroxymethyl Glutamate (HMG) and Alanine Analyses of mixtures for HMG and alanine derived from biochemical reactions were performed using a Waters Alliance 2695 and a Waters 600 configured instrument with a Waters 2487 Dual Wavelengths Absorbance Detector and Waters 2475 Fluorescence Detector as a detection system (Waters, Milford, Mass.). HPLC separations were made using two Phenomenex Aqua C18 125A, 150 mm×2.1 mm, 3µ, Cat #00E-4311B0 columns in series as the analytical columns, and a Phenomenex Aqua C18 125A, 30 mm×2.1 mm, 3µ, Cat #00A-4311B0 as an on-line solid phase extraction (SPE) column. Temperature for the two analytical columns was set at 55° C., and the on-line SPE column was at room temperature. The HPLC mobile phase consisted of A) 0.6% acetic acid with 1% methanol. The flow rate was (100% A) 0.2 mL/min from 0-3.5 minutes, 0.24 mL/min from 3.5-6.5 minutes, 0.26 mL/min from 6.5-10.4 minutes, and 0.2 mL/min from 10.4-11 minutes. UV-VIS absorbance detector was set to monitor at 336 nm wavelength. Fluorescence detector was set at 348 nm and 450 nm to monitor the excitation and emission wavelengths respectively.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1131 sequences)

SEQ ID NO: 1 - DNA, 879 bp, Unknown
  Obtained from environmental sample
gtggcgtgggtcgatggcgaactcgttccgcttcacgaggcccgcattccgcttcttgatcagggtttcctgcattccgatctgacctatgacgtacccgccgtttgggatggcaggtttttccgccttgatgatcacctcgatcgatttgaggtgagctgcgcgaaactgaagctgaaaagcccgatggatcgcgaaaccatgaaggcaacacttgtcgagatggtggcgaaaagcggcatccgtgatgcctatgtggaaatgatcgtcacacgaggtctgaaattcgtgcgcggcaacaaacccgaagacatcgtgaattcgctttacatgctggtcatgccctatgtgtgggtgatgtcaccggaaatacagcgtgttggcggcagtgcggtgatcacccgcacggtgcgtcgtgttcccccgggcgccatcgacccgacgatcaagaacctgcaatggggtgatttcgtgcgcggtctgatggaagcgcaggatcgcggtgccatttacccgatccttcccgatggtgacggcaacatcaccgaaggctccggcttcaatgtgttcctggtcaagaatggcgtgctttacacaccggaccgtggcgttctggaaggtgtgacacgaaagaccgtgttcgatatcgccgccgtcaagggctggaaggttgcccttgaacatgtgccggttgaacttgcctatcatgccgacgaaatctttttctgcacgacggcaggcggcatcatgccggtcacgacgctggatggagaacttgttggcggcggacaggttggcccggtcactcgcgctatttgggacgaatactggaagctgcattacacagaagatttgagttttgcggtggattatccctga

SEQ ID NO: 2 - protein, 292 aa, Unknown
  Obtained from environmental sample
  DOMAIN (5)...(277): Aminotransferase class IV
  SITE (182)...(185): N-glycosylation site. Prosite id = PS00001
MAWVDGELVPLHEARIPLLDQGFLHSDLTYDVPAVWDGRFFRLDDHLDRFEVSCAKLKLKSPMDRETMKATLVEMVAKSGIRDAYVEMIVTRGLKFVRGNKPEDIVNSLYMLVMPYVWVMSPEIQRVGGSAVITRTVRRVPPGAIDPTIKNLQWGDFVRGLMEAQDRGAIYPILPDGDGNITEGSGFNVFLVKNGVLYTPDRGVLEGVTRKTVFDIAAVKGWKVALEHVPVELAYHADEIFFCTTAGGIMPVTTLDGELVGGGQVGPVTRAIWDEYWKLHYTEDLSFAVDYP

SEQ ID NO: 3 - DNA, 855 bp, Unknown
  Obtained from environmental sample
atgcgtactgtttatgtgaacggccagtatgtgccggaaaatgaagccacgatttcgattttcgaccgttccttcctgtttgccgatggcgtctatgaagtcacctcggttctggatggcaaactgatcgattttaacggccatatgacccgccttgcccgctcgctttcggaacttggctttacctatgttcccgatattgatgaactgcttgcggttcaccgcgaactggtcaaacgcaacaatgtgaccgagggtctggtttatcttcaggtctcgcgcggctcggccggggatcgtgatttcgcgatcaacaaggataccccggcaacgctggttttgttcacgcagtccaaatcactgatcaaatccgcccttgccgaacgcggccagaaaatcctgacctacccggatgtgcgctggcgccggtctgacatcaaaaccgttcagcttctctatgcgtcgcttctcaaaaccgaagccgccgccaaaggggccgatgatgcatggatggtacttgatggttatatcaccgaaggctcgtcaaataacgcctatatcgtgaccaaggacaacgtcatcgtcacccgccagctttccaacgacatcctgcacggcatcacccgcaaggcggttttgaaatgcgccgaggaattgcagcttaaagtcgaagaacgcctgttcacggtcgatgaagtcttaaacgccaaagaagccttctcaacctcggcctcggcctttgtctgcccggtcgccgaagttgacggcaccaaaatcggcgacggcaaacccggcccgatcgccaaacgcctgcgcgagatttacatcgaagccaaccgcgccgctgcgatctaa

SEQ ID NO: 4 - protein, 284 aa, Unknown
  Obtained from environmental sample
  DOMAIN (7)...(276): Aminotransferase class IV
  SITE (83)...(86): N-glycosylation site. Prosite id = PS00001
MRTVYVNGQYVPENEATISIFDRSFLFADGVYEVTSVLDGKLIDFNGHMTRLARSLSELGFTYVPDIDELLAVHRELVKRNNVTEGLVYLQVSRGSAGDRDFAINKDTPATLVLFTQSKSLIKSALAERGQKILTYPDVRWRRSDIKTVQLLYASLLKTEAAAKGADDAWMVLDGYITEGSSNNAYIVTKDNVIVTRQLSNDILHGITRKAVLKCAEELQLKVEERLFTVDEVLNAKEAFSTSASAFVCPVAEVDGTKIGDGKPGPIAKRLREIYIEANRAAAI

SEQ ID NO: 5 - DNA, 855 bp, Unknown
  Obtained from environmental sample
atgtcccgtattgcttatgttaacggtgcttatgttccccacgatgaggctgtggtctcgatcgatgatcgcggctatcagtttgctgatgctgtgtatgaaggtgtgactgtgcgcaaaggccgcatgatagaccttgaaccacacatggacaggctcgcgcgctcgatgcgggagcttgcgatggcagcaccgatggagcgcgcgcccatgcgctttgtgttcagggaggttatccggcgcaaccgtataagcgatggatttctctatatacaaatcagccgcggcgtagcccgacgcgaccatgccttccccaccacacccacggcaccgagccttgttgtaacctgcaaacgcctgagtgttgacggtgtttttgcccgcgcagccaagggtgtgaaggccttttcggaaagtgatatccgctggggtcggtgcgatatcaaatccacgtccctgctcccgaacatcctcgcgaaacaggccgccaaggaaaaaggcggctttgaggccgtgcttgtagaccgggacggttatgtaaccgaaggcagcagcaccaacatgtggatggtacgcaccgacggcacgctggtgacccgctcaacggatgataacattctgcccggcattacccgtgcgacgattaaaaagctggcggaagagttgcagatcaaggtggagacaaaagccttcacgctggaagacgccaaagcaggcgcggagatgttcctctcaagctcgactggctgcgccatgccgattgtggagctggacggccataagattggcgacggaacacccggtcccgtcgccagacgattgattgaagcttaccggacttacatggaggcctga

SEQ ID NO: 6 - protein, 284 aa, Unknown
  Obtained from environmental sample
  DOMAIN (8)...(279): Aminotransferase class IV
MSRIAYVNGAYVPHDEAVVSIDDRGYQFADAVYEGVTVRKGRMIDLEPHMDRLARSMRELAMAAPMERAPMRFVFREVIRRNRISDGFLYIQISRGVARRDHAFPTTPTAPSLVVTCKRLSVDGVFARAAKGVKAFSESDIRWGRCDIKSTSLLPNILAKQAAKEKGGFEAVLVDRDGYVTEGSSTNMWMVRTDGTLVTRSTDDNILPGITRATIKKLAEELQIKVETKAFTLEDAKAGAEMFLSSSTGCAMPIVELDGHKIGDGTPGPVARRLIEAYRTYMEA

SEQ ID NO: 7 - DNA, 870 bp, Unknown
  Obtained from environmental sample
atggtttttctgaacgggcagttcgtcgcgttgggggacgccaaggtctccgtgctcgaccgcggcttcatcttcggcgacggcgtctacgaggtcgtgccggtgtactcgcgcgtgccgttccgcctcgacgagcacctcgtgcgactcgagcgcagtctcgccgcggtcgccatccgcaatccgtacagccgcgccgagtggcgcggcttcatcaccgagctggtggcacgccaggacttcgaggaccagggggtctatttccaggttacgcgcggcgtggccaagcgcgaccatgccttcccgaagaacgccgagccgacggttttcatgatggcaagcccgctcgtcaacccgccgcgcgagcaagtggaaaacggcgcgcccgcggtgagcgcgcgcgacaatcgctggctgcgctgcgacatcaagtcgatctcgctcatcggcaacgtgctgctgcgccagctctcggcgcaagtcgacgcggccgagacgatccttttccgcgatggcaagcttaccgaggcctccgcgtcgaacgtgttcattgtgaagttcggcgtcgtcgccgggccgccgaagagctcactcatcctccccggaatcacctacgacgtgatcgtcgagcttgcgcaggctgccggcatcccgctggagctgcgcgaggtaacggaggccgaggtacgcagcgccgacgagctgtgggtgacctcgtcgtccaaggaagtgctcgccatcgtgcacctcgatggcgcgtcgattggcgacgggcggcccggcccggcgttccgccagatgtaccgcctctaccaggatttcaagcagaaggtcatgcgcgcgggccggcgccagtcggtctcggcctga

SEQ ID NO: 8 - protein, 289 aa, Unknown
  Obtained from environmental sample
  DOMAIN (5)...(272): Aminotransferase class IV
MVFLNGQFVALGDAKVSVLDRGFIFGDGVYEVVPVYSRVPFRLDEHLVRLERSLAAVAIRNPYSRAEWRGFITELVARQDFEDQGVYFQVTRGVAKRDHAFPKNAEPTVFMMASPLVNPPREQVENGAPAVSARDNRWLRCDIKSISLIGNVLLRQLSAQVDAAETILFRDGKLTEASASNVFIVKFGVVAGPPKSSLILPGITYDVIVELAQAAGIPLELREVTEAEVRSADELWVTSSSKEVLAIVHLDGASIGDGRPGPAFRQMYRLYQDFKQKVMRAGRRQSVSA

SEQ ID NO: 9 - DNA, 432 bp, Unknown
  Obtained from environmental sample
atgagcatcgtctatctgaacggccgctatcttccgatcgaggaagccaccgtatccgtgctcgatcgcggcttcatctacggcgacggcgtctacgaactggtgcccgtctacggccggacgccgtaccgcatgccgcagcacctgtcgcggctccagcacagcctcgaccgcatccgcctcgccaatccgcactcggacgccgagtgggagagcatcatcggcgggctgatcgagcgccaggagttcgacaaccagggcgtatacctgcaggtcacgcgcggcgtcgccaagcgcgaccacacgttccccaaaggcgtccccgcgaccgtgttcatgatgagcaatccgctcgccacgccgtcggccgacgtcgtcgcgcgcggcgtcgcatgcgtgaccgcgatcgacgagcgctggcgcaattctttg

SEQ ID NO: 10 - protein, 144 aa, Unknown
  Obtained from environmental sample
MSIVYLNGRYLPIEEATVSVLDRGFIYGDGVYELVPVYGRTPYRMPQHLSRLQHSLDRIRLANPHSDAEWESIIGGLIERQEFDNQGVYLQVTRGVAKRDHTFPKGVPATVFMMSNPLATPSADVVARGVACVTAIDERWRNSL

SEQ ID NO: 11 - DNA, 879 bp, Unknown
  Obtained from environmental sample
atggttcgtacggtctatgtaaacggatattatgcgccgtatgagcatgccgtcgtgcatgtcgaggatcggggctatcaattcgcagatgccgcctatgaggtttgcgaagtacgcggcggagcgctgatcgacgagcgcctgcatatggaacggctgcgccggtcgctgggcgagctcagaattgattttcccatgaccatgcgctccctcagcgtgatcctgcacgagacggtgcgccggaaccgggtccgcgacggctccgtctatctccaggtaagccgcggcgtcgccccgcgcgactttgccttcccggacccatccgcgaggccgagcgtggtctgctatgccaaggcgaagccggctgccgcattggagcgccgggcggccaagggcatccgcgtcgtcaccatgccggatatccgctggcgccggccggacatcaaatcggtctcgctgctgcccaatgtgctggcgcggcaggcagcccacgatgtcggagccgacgaagcctggctggtcgacgacaacggctttgtcaccgaaggcgccgcctgcaacgcctggatcctgatcgaggacgatacgctcgtcacccggccggccgaaatggccattttgcgcggcgtcacccgcaccgttctgctgcaggcaattgccgaggcacagctcaaggttgttgagcggccgttcagcgtcgaagaggcaaaaagggccaaggaggccttcataacgtcggcaacgtcgatcataacgccggtgatcgcgataaacggtgtgcccctgggcgacggcaagcccggaccggtagcaatgaagctgcgccggctcttccggggctcggccgagaaatcaggagccggaacgttgttggaatag

SEQ ID NO: 12 - protein, 292 aa, Unknown
  Obtained from environmental sample
  DOMAIN (8)...(279): Aminotransferase class IV
MVRTVYVNGYYAPYEHAVVHVEDRGYQFADAAYEVCEVRGGALIDERLHMERLRRSLGELRIDFPMTMRSLSVILHETVRRNRVRDGSVYLQVSRGVAPRDFAFPDPSARPSVVCYAKAKPAAALERRAAKGIRVVTMPDIRWRRPDIKSVSLLPNVLARQAAHDVGADEAWLVDDNGFVTEGAACNAWILIEDDTLVTRPAEMAILRGVTRTVLLQAIAEAQLKVVERPFSVEEAKRAKEAFITSATSIITPVIAINGVPLGDGKPGPVAMKLRRLFRGSAEKSGAGTLLE

SEQ ID NO: 13 - DNA, 852 bp, Unknown
  Obtained from environmental sample
atgaacgcactaggatattacaacggaaaatggggtcctcttgacgaaatgaccgtgccgatgaacgacaggggctgcttctttggagacggcgtgtacgacgctacctgcgccgctaacggggtgatttttgccctggatgagcacattgacaggtttttcaacagcgcaaaactcctggaaatagaaatcggttttacaaaagaggaactgaaaaaaaccatcaatgaaatgtactccaaagtggataagggggagtaccaggtttattggcaggcgactcgtggaaccggccggcgaagccatgtatttccggcaggtccctcaaatctctggataatgattaagcctaatcacgtcgacgatctttatagaaaaataaagctcattaccacggaagatacccgctttttccactgcaacatcaaaacacttaaccttattcccaatgtcattgcttcccagcgagcgctggaagcgggctgccacgaggcagtttttcaccggggcgaaacagtgaccgaatgcgcccatagcaatgtccacataattaaggacggcaggtttattactcatcaaactgacaacctgatcctccctggcatagcccgcagccatttgttgcaagcctgcgacaggctgaatgttccggttgacgaacgggaatttaccctttcggaattgttcggcgcggatgaggtacttgtgtccagcagcggcacactcggtcttagcgccgatacaatagacggaaaaaatgtgggagggaaagcgccggaactgctaaaaagaattcaggacgaagtgttgaaggaatttatcgaagcgacagctcgtgccgaattctttgga

SEQ ID NO: 14 - protein, 284 aa, Unknown
  Obtained from environmental sample
  DOMAIN (8)...(270): Aminotransferase class IV
MNALGYYNGKWGPLDEMTVPMNDRGCFFGDGVYDATCAANGVIFALDEHIDRFFNSAKLLEIEIGFTKEELKKTINEMYSKVDKGEYQVYWQATRGTGRRSHVFPAGPSNLWIMIKPNHVDDLYRKIKLITTEDTRFFHCNIKTLNLIPNVIASQRALEAGCHEAVFHRGETVTECAHSNVHIIKDGRFITHQTDNLILPGIARSHLLQACDRLNVPVDEREFTLSELFGADEVLVSSSGTLGLSADTIDGKNVGGKAPELLKRIQDEVLKEFIEATARAEFFG

SEQ ID NO: 15 - DNA, 837 bp, Unknown
  Obtained from environmental sample
atgagagaaattgtttttttgaatggggaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggatattgaaaatcttcaatcggtttttaactcactcataaccagaaataatcttaatgataaacacgcaggggtatatttgcaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatattaaatcggtttcactgcttcccaatacaatgctgtataacaaagccgtaaatgccggggcgggagagtgcgttttaattcgcaatggaatggttaccgaagctacacattcaagcgttttgtgtgtaaaagacggaattgttattacacgaccactatcaaatctgattcttcccggaattacaagaaaagttgtacaggagatatgctctgtccataatattgcttttgaagagcgcgaattttctgaaactgaattgcttgaaatggatgaaattataattgctggtacggggagcgaaataactccggcaatacaagtaaacgaaacaacgattggaaatggctcaccaggcaaaatcacacggtttattcagcaaaagttttttgagatggtttaa

SEQ ID NO: 16 - protein, 278 aa, Unknown
  Obtained from environmental sample
  DOMAIN (8)...(275): Aminotransferase class IV
  SITE (1)...(4): Tubulin-beta mRNA autoregulation signal. Prosite id = PS00228
  SITE (257)...(260): N-glycosylation site. Prosite id = PS00001
MREIVFLNGEFLEKEAAKISPNDRGFIFADGVYEVAKYYNGRPFRYDDHLKRLERSLSELEIEYPDIENLQSVFNSLITRNNLNDKHAGVYLQITRGEHKRVHHFPENVQPTVYAFAFELPSFKENLEKGIKVITHEDIRWQRCDIKSVSLLPNTMLYNKAVNAGAGECVLIRNGMVTEATHSSVLCVKDGIVITRPLSNLILPGITRKVVQEICSVHNIAFEEREFSETELLEMDEIIIAGTGSEITPAIQVNETTIGNGSPGKITRFIQQKFFEMV

SEQ ID NO: 17 - DNA, 918 bp, Unknown
  Obtained from environmental sample
atgttggatgaacggatggtgttcattaacggcgactttgtaaagtggcaggacgcaacggtccacatgatgagccacagcttcgcgcgcggctcggccattttcgaagtcatcagcttttacgcgacgggctcgggtccggctgttttccggctggacgatcacatcgcgcgtttggaaaaatcggcaagcttcctgggcatggagcttcccctgagccacgaggcactgtgccgggccgtggcggacaccgtgcgccgcaaccgcctcggtcggggcgtcatcaaggtgatcggctactacccccagttcgcgctcgacattcagccgccgcagaagcgtctggatgttgcggtctttgcgctggagccggcgcaggacctgaaggactttgagttttcctttgaaaagggcaccagtgcaggcatcgcgcgctggcgcaaactcgaccccgagacggtccccatcgaggccaaggccgccgccaactacctgaacgggatgatcgccagccaggatgtccggaaacgagggttcgaggatgccatcctgctggacacccagggattcatcgccgagggcgccaccgaatccgtttttctggtcaaagacggcaagctgctgacgccctgcctggggaccgtgctcgacagcatcacccgccggtccattttgcaggtcgcgcgccatctcgggatcgaaacgatcgaaggccgtctgcggccggcgctgctcttcgaagccgatgaggtctttttcgccaacacccccttcaaggtgatccccgtccgtcgcatcgaggagcgccggatgtcggccactcccggcccgatgcagcgcaggttgtgggatgttttgcagaagatcgccgccggccaagagcctgacttcgccgagtggctctatgccgtggactga

SEQ ID NO: 18 - protein, 305 aa, Unknown
  Obtained from environmental sample
  DOMAIN (10)...(287): Aminotransferase class IV
MLDERMVFINGDFVKWQDATVHMMSHSFARGSAIFEVISFYATGSGPAVFRLDDHIARLEKSASFLGMELPLSHEALCRAVADTVRRNRLGRGVIKVIGYYPQFALDIQPPQKRLDVAVFALEPAQDLKDFEFSFEKGTSAGIARWRKLDPETVPIEAKAAANYLNGMIASQDVRKRGFEDAILLDTQGFIAEGATESVFLVKDGKLLTPCLGTVLDSITRRSILQVARHLGIETIEGRLRPALLFEADEVFFANTPFKVIPVRRIEERRMSATPGPMQRRLWDVLQKIAAGQEPDFAEWLYAVD

SEQ ID NO: 19 - DNA, 861 bp, Unknown
  Obtained from environmental sample
atggacgcgctgggctattacaacggaaaatgggggcctctggacgagatgaccgtaccgatgaacgacaggggctgttactttggggacggcgtgtacgatgctgcctgcgccgccaacggaacgatctttgccccggatgagcatattgaccggtttttcagcggcgcaaagctcctggaaataagaatcaccttaacaaaagaggaacttaaaaaaacccttaacgagatgctctgtaaagtagacaagggggagtacctggtttattggcaggcgactcgcggaacaggccgtcgaagccatgtgtttccggcaggcccctcaaatctctggattatgataaagccccaccccatcgacgatctttacaaaaaaataaagctcattaccatggaagacacccgctttcttcactgcaacatcaagacccttaaccttattcccaatgtcattgcctcccagcgggcgctggaagcgggctgctacgaaacggtatttcaccggggcgaaacagtaaccgagtgtgcccacgacaatgtccacatcatcaaaagcggcaggtttatcacccatccggtagacaacctaatcctccggggcatagcccgcagtcatttgttgcaagcttgcgacaggctgaacattccggttgaagaacgggaatttagcctgtcggagttgtttgacgcggacgaggtgcttgtgtccagttgcggcagtttcggtcttagcgccgatgcaattgacggaaaagacgtgggaggaaaagcgccggaactgcttaaaaaaattcaggacgaggtgcttagggaatttgtcgaagcgacaggctacgcgcccgcctggagcagggtgtag

SEQ ID NO: 20 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFSGAKLLEIRITLTKEELKKTLNEMLCKVDKGEYLVYWQATRGTGRRSHVFPAGPSNLWIMIKPHPIDDLYKKIKLITMEDTRFLHCNIKTLNLIPNVIASQRALEAGCYETVFHRGETVTECAHDNVHIIKSGRFITHPVDNLILRGIARSHLLQACDRLNIPVEEREFSLSELFDADEVLVSSCGSFGLSADAIDGKDVGGKAPELLKKIQDEVLREFVEATGYAPAWSRV

SEQ ID NO: 21 - DNA, 861 bp, Unknown
  Obtained from environmental sample
atggacgcactgggatattacaacggaaaatggggccctctggacgagatgaccgtgccgatgaacgacaggggctgctactttggagacggagtatacgacgccaccatcgccgctaatggggtgatctttgccctggacgagcacattgacaggtttttcaacagctcgaagcttctggaaataaaaatctgtataacaaaagaggaacttaaaaaaacacttaatgatatgcacttcaaagtggataaaggggtgtacatggtttattggcaggcgactcgcggaacaggccgacgaaaccatgtatttccggcaggtccttcaaatctctggataatgataaagcccaatcacatagacgatcttaataaaaaaataaagctcattaccacggaagatacccgcttcctccactgcaatatcaagacccttaaccttattcccaatgtcattgcctcccagcgggcgctggaagcgggctgccaggaagcggtttttcaccggggcgaaacggtaaccgagtgcgcccacagcaatgtccatataatcaagaacggcaggtttatcacccatcaggcggacaacctgatcctccggggcatagcccgcagccatttgttgcaagcctgcgacaggctgaacgttccggttgacgaacgggaattcaccctcccggaattatttgacgctgacgaggtgcttgtgtccagtagtggcacattcggccttagcgccgatacaatcgacgggaaaagcgtgggaggaaaagcgccggaactgcttaaaaaaattcaggacgaagtaatgagggaatttatcgaagcaacaggctacacgcctgagtggagaaaggcatag

SEQ ID NO: 22 - protein, 286 aa, Unknown
  Obtained from environmental sample
  DOMAIN (8)...(270): Aminotransferase class IV
  SITE (55)...(58): N-glycosylation site. Prosite id = PS00001
MDALGYYNGKWGPLDEMTVPMNDRGCYFGDGVYDATIAANGVIFALDEHIDRFFNSSKLLEIKICITKEELKKTLNDMHFKVDKGVYMVYWQATRGTGRRNHVFPAGPSNLWIMIKPNHIDDLNKKIKLITTEDTRFLHCNIKTLNLIPNVIASQRALEAGCQEAVFHRGETVTECAHSNVHIIKNGRFITHQADNLILRGIARSHLLQACDRLNVPVDEREFTLPELFDADEVLVSSSGTFGLSADTIDGKSVGGKAPELLKKIQDEVMREFIEATGYTPEWRKA

SEQ ID NO: 23 - DNA, 861 bp, Unknown
  Obtained from environmental sample
atggacgcactgggatattacaacggaaaatgggggcctctggacgagatgaccgtgccgatgaacgacaggggttgtttctttggggacggagtgtacgacgctaccatcgccgctaacggagtgatctttgccctggacgagcacattgaccggtttttaaacagcgcaaagctcctggaaatagaaatcggttttacaaaagaggaattaaaaaaaactttttttgaaatgcactccaaagtggataaaggggtgtacatggtttattggcaggcgactcgcggaacaggccgtcgaagccatgtatttccggcaggtccctcaaatctctggattatgattaagcccaatcacgtcgacgatctttatagaaaaatcaagctcattaccatggaagatacccgcttcctccactgcaacatcaagacccttaaccttattcccaatgtcattgcctcccagcgggcgctggaagcgggctgccacgaggcggtctttcaccggggtgaaacagtaaccgagtgcgcccacagcaatgtccacatcattaaaaacggcaggtttatcacccaccaggcggacaacctaatccttcggggcatagcccgtagccatttattgcaagcctgtatcaggctgaacattccatttgacgaacgggaatttaccctttcggaattatttgacgcggatgagattcttgtgtccagcagcggcacactcggccttagcgccaatacaattgatggaaaaaacgtggggggaaaagcgccggaactgctaaaaaaaattcagggcgaagtgttgagggaatttatcgaagcgacaggctacacgcctgagtggagcacagtatag

SEQ ID NO: 24 - protein, 286 aa, Unknown
  Obtained from environmental sample
  DOMAIN (8)...(270): Aminotransferase class IV
MDALGYYNGKWGPLDEMTVPMNDRGCFFGDGVYDATIAANGVIFALDEHIDRFLNSAKLLEIEIGFTKEELKKTFFEMHSKVDKGVYMVYWQATRGTGRRSHVFPAGPSNLWIMIKPNHVDDLYRKIKLITMEDTRFLHCNIKTLNLIPNVIASQRALEAGCHEAVFHRGETVTECAHSNVHIIKNGRFITHQADNLILRGIARSHLLQACIRLNIPFDEREFTLSELFDADEILVSSSGTLGLSANTIDGKNVGGKAPELLKKIQGEVLREFIEATGYTPEWSTV

SEQ ID NO: 25 - DNA, 840 bp, Unknown
  Obtained from environmental sample
atgcagaaggtttttttaaacggtgaatacctgcccttgccggaagccaaggtttcggttctggatcgcggttttttgtttggcgatggcgtttacgaagttattccggtctatgcggggcatttattcaggatggccgaccatatcgagcggttgaacaatagcctggcgggtatacgtctgcctttggattatagcgtcgacgactggcgggcgatttttgcgcctttgttggacggcggcaaggatcaatatatctatttacaaattacccgcggctatgcgccgaaacgcgatcacgcttttcctgaacaagtcataccgactatttttgccatgtgttcggatattacgcctttcccggaaaaatttaccggcatcaaagccgtctccgtggacgatatccgctggcaactatgccatatcaaggccattaccttgctggccaacattctgttgcggcaacaggccgtcgagcagggcggtgccgaggctattctggtaaaaaacggctatgttatcgaaggagctgcgagtaacgtttttaccgtgatcgatggggtattgattaccccgccaaagtcgaatgagattctgcccggtatcacccgcgatgttgtcctgaagctggcgcaagcccatggcttgccgttccgggaagatattatcgccttggaagcgttacgctccgccgacgaaatttgggtcgccagttccatccgggaaattctgccggtcgtggaattggacggagtagccgtagccggcggcaaacccggagcgatatggcgcgacatggataactatttgcaagcctataagaaatcctgtcatgactga

SEQ ID NO: 26 - protein, 279 aa, Unknown
  Obtained from environmental sample
  DOMAIN (7)...(271): Aminotransferase class IV
  SITE (53)...(56): N-glycosylation site. Prosite id = PS00001
MQKVFLNGEYLPLPEAKVSVLDRGFLFGDGVYEVIPVYAGHLFRMADHIERLNNSLAGIRLPLDYSVDDWRAIFAPLLDGGKDQYIYLQITRGYAPKRDHAFPEQVIPTIFAMCSDITPFPEKFTGIKAVSVDDIRWQLCHIKAITLLANILLRQQAVEQGGAEAILVKNGYVIEGAASNVFTVIDGVLITPPKSNEILPGITRDVVLKLAQAHGLPFREDIIALEALRSADEIWVASSIREILPVVELDGVAVAGGKPGAIWRDMDNYLQAYKKSCHD

SEQ ID NO: 27 - DNA, 801 bp, Unknown
  Obtained from environmental sample
atgggtgcaagcgagacgctggcgtcgatcgacggccagatcgtgccgctcgatcaggcgacgatcctgatcaccgatcagggcctgatccgtggcgacggggcgttcgaagtcgtgcggctcttcgacggtgtgccgttcgcgctggaccagcatttcgagcgcctgcaacgctccgccgaaaacctgctgctcccagtggacgtggagctggtgcacagcgaggcgctggcgctgctggcggccagtaacgccgcgggtgtggagcatcagctgatgcggatcatgctgacccgtggcgggcgacggatcgtgctgaccgagccgatgccgttcgagcccgaggaggcgcgcctgaagacgatcacctaccagccgaccctcgtgctggacggcgtcaagtcgctctcgtatgccgcgaacatgctcgccacccggcgggcggtggcggcgggctacgacgaggcgctgctggtgacgcccgcgggccgggtgctggaagccccgaccgcgtcgctgttctgggtgaagaacggtgagctgcgcacgccgccgctgagcgatcacatcctcgcctcgatcacccgcggcctgctgctggagctcacctccgcggtcgagtacccgacggcgctcccggagctgctcgaggcggatgaggtgttcctcgcctcgaccacccgtgaggtccagccggtctgcgagatcgacgggcgccgcttcctcaccggcggcccggtcgcgagcgcgaccgatcagacggtccaggcccacctcgcggagctgctcgcgcgggcgtga

SEQ ID NO: 28 - protein, 266 aa, Unknown
  Obtained from environmental sample
  DOMAIN (11)...(256): Aminotransferase class IV
MGASETLASIDGQIVPLDQATILITDQGLIRGDGAFEVVRLFDGVPFALDQHFERLQRSAENLLLPVDVELVHSEALALLAASNAAGVEHQLMRIMLTRGGRRIVLTEPMPFEPEEARLKTITYQPTLVLDGVKSLSYAANMLATRRAVAAGYDEALLVTPAGRVLEAPTASLFWVKNGELRTPPLSDHILASITRGLLLELTSAVEYPTALPELLEADEVFLASTTREVQPVCEIDGRRFLTGGPVASATDQTVQAHLAELLARA

SEQ ID NO: 29 - DNA, 849 bp, Unknown
  Obtained from environmental sample
atgaaagagctgggctattacaacggaaaaatcggggaattaagcgaaatgaccgtgcccatgaatgaccgggcctgctggtttggggacggggtctatgaggccggcatgtgccgggatgggcagatcttcgccctggatgagcatgtggatcggctctttcgcagcgcggccatgctggaaatccgggttcccgtttccaaagaggagctgaagcagctgttatatgatcttatcggaaagatggataccggcgatctcctggtgtattatcaggtcacccggggctgcggtccccggggccacgccttccccgatggtcccgccagcctgtgggtcaccctgcggccgaaaaccctgaatccctttctgcctcccgtctccctgatcacggatccggatacccgctttttccattgcaatatcaagaccctgaacctgatcccctcggtcatggcgaatgagaaggccaggcgggccggctgttacgagtgcgtgctgtatcggcccggcggccgggtcacggaatgctcccacagcaatgtgcatatcatccgggacggcgtcttcatcaccgccccgacggatgagctcatcctgcctgggatcgcccgggcccatctgatcagggcttgttccgcgctggggatccccgtccgggaaactcccttcaccgtggaggatctgaaagccgccgacgagatcctgacctccagctccaccgcgccctgcatccgcgcctgccgggtcgacgggcaggcagccggtatgcggcggccggatctgtttgatgcgctgcatcgggcggtttttgatgagtattttggaaatcaggggtggaggtcatga

SEQ ID NO: 30 - protein, 282 aa, Unknown
  Obtained from environmental sample
  DOMAIN (8)...(271): Aminotransferase class IV
MKELGYYNGKIGELSEMTVPMNDRACWFGDGVYEAGMCRDGQIFALDEHVDRLFRSAAMLEIRVPVSKEELKQLLYDLIGKMDTGDLLVYYQVTRGCGPRGHAFPDGPASLWVTLRPKTLNPFLPPVSLITDPDTRFFHCNIKTLNLIPSVMANEKARRAGCYECVLYRPGGRVTECSHSNVHIIRDGVFITAPTDELILPGIARAHLIRACSALGIPVRETPFTVEDLKAADEILTSSSTAPCIRACRVDGQAAGMRRPDLFDALHRAVFDEYFGNQGWRS

SEQ ID NO: 31 - DNA, 1062 bp, Unknown
  Obtained from environmental sample
atgaaaaacaaactaactaaaccatacgcaatcgaaccacgctgttcgattgatcttaccctaagcgaaaatcccttggggtgttcgcctatggttaccaacaaaatccgtaaggacacatcacaatgtgtccctatcccaaaccgttacccatcatcaaatggcaatctgttaaaaaagaagttagccgatgcatttggtggagaatcaaacaactttttcataactaacggttcggaaaatatcattctaaatattcccagaatcttggctaaacccggagatggtgtggtaatccccgaattatcatttccattgtttgcactttattgtggatttgccggattgagtattcagcttgtaccgatgaaaaatgatctaggaattgatttggcgaaatgtaaggatgtcgcattgcaacgtcctttccctcgcctcgtcttcatctgcaatcctaataatcccaccggtatgcttttaaaacgatctgacattctggaatttttggataaaatcccagaagatatcatcgccatcatcgacgaagccaacattgattttggtggtgagagcgtgatcgaccaagccttcattcgcccaaatgtattggtgctgagaactttttccaaagggttcggattggctggtatgcgtgttggctttgcagttggcgataaggaattgattcgaaagttaactgagcaaactcccccatttccaattacgagcttgagtgagcaactggcaatcacagcactgcgtgacttagaattcgtggaacagtcaagacagtacatgactagacagagagaaattattaaatccaaactcaaaaatcttgggtgtactgttttcaactctcaagcgaataatatatttgcgaaactaccagacaggatcaatccagaccaattttttaaaaaactgaaccaaaatgatgtctcggtagtcaaaggtagcaaatttacaggttttgacgattcgtattttagaatcagtccgagagatgagaagactaatcaacgatttattaaaattatagagaaagtattaattgtgtag

SEQ ID NO: 32 - protein, 353 aa, Unknown
  Obtained from environmental sample
  DOMAIN (14)...(347): Aminotransferase class I and II
  SITE (78)...(81): N-glycosylation site. Prosite id = PS00001
  SITE (210)...(219): Aminotransferases class-II pyridoxal-phosphate attachment site. Prosite id = PS00599
MKNKLTKPYAIEPRCSIDLTLSENPLGCSPMVTNKIRKDTSQCVPIPNRYPSSNGNLLKKKLADAFGGESNNFFITNGSENIILNIPRILAKPGDGVVIPELSFPLFALYCGFAGLSIQLVPMKNDLGIDLAKCKDVALQRPFPRLVFICNPNNPTGMLLKRSDILEFLDKIPEDIIAIIDEANIDFGGESVIDQAFIRPNVLVLRTFSKGFGLAGMRVGFAVGDKELIRKLTEQTPPFPITSLSEQLAITALRDLEFVEQSRQYMTRQREIIKSKLKNLGCTVFNSQANNIFAKLPDRINPDQFFKKLNQNDVSVVKGSKFTGFDDSYFRISPRDEKTNQRFIKIIEKVLIV

SEQ ID NO: 33 - DNA, 852 bp, Unknown
  Obtained from environmental sample
atggcaaagattttatggaatgatcaaatcgtagaagaaaaagaagtgaaaattggttttgaagaccgtgggtatcaatttggtgatggagtatatgaagtagtcaaaatttataatggtgatttgtttacggcaaaggaacatatagatcgcctgtatgcaagtgctgacaaaattcaaatagtcataccctttacaaaagataagctacatcaattaatgcacgaattaattgaaacgaacgaggttaagaacggtcagatttatttacagatcacacgaggggacagtccacgagttcataacttccctaatccagcagtgaactctgtactaaccgcttatactaaagaaacaaaacgtccactggcacagcaggaaagtggtatcaaagcttgttttgtagaggatattcgatggttaagatgtgatataaaatcactaaacctacttggtaacgtgcttgcaaaacaagaagcagttactaaaggttgctttgaagccattttacatcgtggggaaactattacagaaggttcttcctctaatatgtacggcattaaagatggtgttttgtatacacatccgattagtaacctaattttaaatggtattactagaaaagtgctgttagattgctgtgaggaaataggacttaaggtagttgaagaggcgtttacgaaagaagaggcgctaaacatggacgaatttatcatgtcatcaactagcgctgaggtaatgccggttatatccatcgatgggaatgttattggggacggaaaacctggagagtttacaagaaagcttcagaaagcctttgaacaaaaaattccatccactttaaatgtatga

SEQ ID NO: 34 - protein, 283 aa, Unknown
  Obtained from environmental sample
  DOMAIN (7)...(274): Aminotransferase class IV
MAKILWNDQIVEEKEVKIGFEDRGYQFGDGVYEVVKIYNGDLFTAKEHIDRLYASADKIQIVIPFTKDKLHQLMHELIETNEVKNGQIYLQITRGDSPRVHNFPNPAVNSVLTAYTKETKRPLAQQESGIKACFVEDIRWLRCDIKSLNLLGNVLAKQEAVTKGCFEAILHRGETITEGSSSNMYGIKDGVLYTHPISNLILNGITRKVLLDCCEEIGLKVVEEAFTKEEALNMDEFIMSSTSAEVMPVISIDGNVIGDGKPGEFTRKLQKAFEQKIPSTLNV

SEQ ID NO: 35 - DNA, 1143 bp, Unknown
  Obtained from environmental sample
atgagcgaagaagcctccgcgcagctgtacgctagccttggcgtgcggcccgtgatcaatgctgccggcgcttacacgattttgggcggctcggcgccggccccagccgtgctccaggcgatggaggaagcgaaccgctacttcgtcgagatgcgcgacctcctggcggcgagcggcaagctcatcgccagcatgctcgagtgcgaggcggcctacgtcacgtccggcgctgctggcgccctcgccctctccgccgccgcctgcatgaccggcacggacttcgagaagatcgagcagctgccggacaccacagggatgaagaatgaaatcctcgtccagacgttgctgcgcaccaagtacgaccgctgcgtgacgatcccgggcgcccgcctggtgccggtcggcgacgagaacggcacgacggccgatcagctgcgggcggcgataagcgagcgcacagccgcggtgcacttcctcgcacccggcggccagcgaggcgtcctgccaattaagcaggtaatcgagatcgcccatgcggcgggagtgccggtcatcgtcgacgccgctggccagacctacccgctcgataatctcaagaagtacacacggatgggcgccgacctcgtatgctacgcagcgaagtacttcgacgcgccccattcgactggcatgatcctgggacgttccgacctcatagaggccgccgcgctcaacagcttcatcggtttcgagaccacgggccacctctcgtttggccgggcgatgaaaatcgaccggcaggagatcatcggcctcgtcgtcgctctgcgcgaatggctggcgatgaatcatgaggagcgcttcctgcgctacggagaacgcgcggaacggatcctgggtgcgatcaagggggtgccgggcatcgaggcctaccgcatctcggagcgagaaacgccaccaccggtcgtccgcgaaggcgtcaggatcaaccttctgcctggtttcgggcgttccgcagccgcgattgcgtccgaccttaaggacggctcgccgagcatctgggtcggatttggcgaaagcagcctcaatgtatcggtcgcgttcttccaagatgaggatgcggaaatcgtcgcgcgacggctgcgcgaggcgcttggcgcctga

SEQ ID NO: 36 - protein, 380 aa, Unknown
  Obtained from environmental sample
  DOMAIN (18)...(360): L-seryl-tRNA selenium transferase
  SITE (140)...(143): N-glycosylation site. Prosite id = PS00001
  SITE (361)...(364): N-glycosylation site. Prosite id = PS00001
MSEEASAQLYASLGVRPVINAAGAYTILGGSAPAPAVLQAMEEANRYFVEMRDLLAASGKLIASMLECEAAYVTSGAAGALALSAAACMTGTDFEKIEQLPDTTGMKNEILVQTLLRTKYDRCVTIPGARLVPVGDENGTTADQLRAAISERTAAVHFLAPGGQRGVLPIKQVIEIAHAAGVPVIVDAAGQTYPLDNLKKYTRMGADLVCYAAKYFDAPHSTGMILGRSDLIEAAALNSFIGFETTGHLSFGRAMKIDRQEIIGLVVALREWLAMNHEERFLRYGERAERILGAIKGVPGIEAYRISERETPPPVVREGVRINLLPGFGRSAAAIASDLKDGSPSIWVGFGESSLNVSVAFFQDEDAEIVARRLREALGA

SEQ ID NO: 37 - DNA, 1389 bp, Unknown
  Obtained from environmental sample
atgagcacccccccaaccaattcggcgatcatcacggactacaaggcgcggacccaggggtcgggtgcgctgtttgagcgcgcccgcaaggtgctgccgagcggcatcacgcacgatgcgcgctacctcgacccctattcgatccacgtcgccaaggccaaggggccacgcaagtgggacgtcgatggcaacgagtatgtggattacttcggcggccacggcgccatgctgctcggccattcgcaccccgccgtcgtcgaggcggtgaagaaacagatcgagctgggcacccattacggctcgagccacgagctcgaggtgcgctgggccgagctggtgtgcgagctgacgccgtgcgccgagaaggtgcgcttcaccgcatcagggaccgaggcctcgcacatggcgatccgtctcgcccgtgcctacaccggcaaggacaaggtcgtgcgcttcatcggccatttccatggctggcacgacaatgtcacggccggcgccggcgcgacctatgacggcggcaccacaccgggcgtgccgcagcaggtgagcgacctctcgatcgtgatgccgagcaacgacgtcgccgccgtggtcaagctgatcgaggagcgcgacgacatcgccgtggtgatgttcgagccctccggcgcctcctggggccaggtgccgctgccgccgggcttcgtccaggcggtgcgcgacgccacggccaagaagggcgtgctgatgctgatggacgaggtgatcaccggctaccgctggtcgtcgggcggcgcgcagaaggcttttggcatcacgcccgacctctgcatccaggccaagatcgtggccggcggcctgccgggcggcgcggtcgccggcaagcgcgacatcctcgaccgcatcgatcacgacgccaccgcggcgaagaagatcgagcgcatcctccatcccggcacctacaacgccaacccgttgtcggccgcggcggcggtgacggcgctcaccctggtgcgcgacgaggatctcgcggagaaggccaacaagaccgcggccgagctgcgcaaggcgctgaccgaggtgctggtgaaggagggcgtgccgtggggcatctacggccagagctcgaccttcctgatctatcccaatccgttcggcgatccgatcgatcccgcgaccttcgatccgcagaaggtgccgatcgccaagctcaagggcgcccgcggcgccggcccgctcaccggcaagatccgcatgggcctgatgacccacggcgtcgacgtgatgggtgcgcccggcggcttcgtctcggcgacccacggcggcgccgagatcgagaagaccgtccatgcgctgcgcgagaccgtgcgggcgctcaaggccgagcgcgaagtgaaggccgcgtga

SEQ ID NO: 38 - protein, 462 aa, Unknown
  Obtained from environmental sample
  DOMAIN (49)...(367): Aminotransferase class-III
  SITE (164)...(167): N-glycosylation site. Prosite id = PS00001
  SITE (347)...(350): N-glycosylation site. Prosite id = PS00001
MSTPPTNSAIITDYKARTQGSGALFERARKVLPSGITHDARYLDPYSIHVAKAKGPRKWDVDGNEYVDYFGGHGAMLLGHSHPAVVEAVKKQIELGTHYGSSHELEVRWAELVCELTPCAEKVRFTASGTEASHMAIRLARAYTGKDKVVRFIGHFHGWHDNVTAGAGATYDGGTTPGVPQQVSDLSIVMPSNDVAAVVKLIEERDDIAVVMFEPSGASWGQVPLPPGFVQAVRDATAKKGVLMLMDEVITGYRWSSGGAQKAFGITPDLCIQAKIVAGGLPGGAVAGKRDILDRIDHDATAAKKIERILHPGTYNANPLSAAAAVTALTLVRDEDLAEKANKTAAELRKALTEVLVKEGVPWGIYGQSSTFLIYPNPFGDPIDPATFDPQKVPIAKLKGARGAGPLTGKIRMGLMTHGVDVMGAPGGFVSATHGGAEIEKTVHALRETVRALKAEREVKAA

SEQ ID NO: 39 - DNA, 1077 bp, Unknown
  Obtained from environmental sample
atgcccaagcatcgcaaggctcgcttgcgtcgccaagggctggcggctaagcacggcccgacttttcgcacttcggagcctgccttgaccggtcaagtgaataccaagccccgcggccgccagttcttcaacaatccgggtccgaccaacattcccgaccgcatcctgcgggcgatggaccggccggtgatggacttcctcgcccccgaattcctcgagatgcaccgcgcctgctacgccggcatgaagcgcatcttcaagaccgaccaggaaatctacttccatgcctcgaccggccacggcgcctgggaagcggcggtcgccaacctgttctcgcccggcgacctcgtgctggtgatcgagaccggctacttctcgctgggcttcaaggagctcgccgagacgctcggcctgaaggtcgaggtggtcggcgccgactggcgcaagggcctcgagttcgcgaagctcaccgagcgcctcgccgccgacaagggccacgagatcaaggccgtgctcgccgtgcacaacgagaccgcgaccggcatggtgctgccgctcgccgaggtccgccgcgcgatggaccagaccaagcatccggcgctgctgctcagcgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaaggccaagctgcccaagtactacttcaactgggagctgatggagcagcgcaagccgcagcgcttcatcgggaccgtgccggtccatttcttcttcggcctgaccgagtcgatcaagatgatcgaggaggagacgctggaaggcgtgttctcccgccacgcccggctcggcgaggcgacccgcgccgcggtgcgcgcctggggcaaggacggcaagggcccgtcgctgttcggccagaccgaggaccgtctctccaactcggtcaccacggtgatgatgcccgagggccacacctccgacgccctcgtgccgaattct

SEQ ID NO: 40 - protein, 359 aa, Unknown
  Obtained from environmental sample
  DOMAIN (41)...(355): Aminotransferase class-V
  SITE (178)...(181): N-glycosylation site. Prosite id = PS00001
MPKHRKARLRRQGLAAKHGPTFRTSEPALTGQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETLGLKVEVVGADWRKGLEFAKLTERLAADKGHEIKAVLAVHNETATGMVLPLAEVRRAMDQTKHPALLLSDTISSLGSMEYKMDAWGIDVTIAGSQKGLMLPTGMAITGVSKKALEASRKAKLPKYYFNWELMEQRKPQRFIGTVPVHFFFGLTESIKMIEEETLEGVFSRHARLGEATRAAVRAWGKDGKGPSLFGQTEDRLSNSVTTVMMPEGHTSDALVPNS

SEQ ID NO: 41 - DNA, 852 bp, Unknown
  Obtained from environmental sample
atgtattcattatggaatgatcaaatagtgaaggatgaagaagtaaagattgataaagaagaccgaggctatcaatttggagacggcatatacgaagtaattaaagtgtatgacggtgaaatgtttacagctgaggaacatatcgatcgtttttatgaatgtgcagaaaaaattcgattaacaattccatatacgaaacataaacttcatcaattgttacatcaattagtagaagcaaatgagttaaagacaggacatatctatttccaaattacacgtggggttgcgtcacgagtacacaatttcccagcaggcaatgtgcagcctgtattatcagggacgacaaaagaatttccaagacctgtagaaaactttgaaaaaggggtaaaggcaacttttacagaagatattcgttggctacgatgtgatataaaatcactgaacttattaggtgcagtattagcgaaacaagaagcgattgaaaaagggtgttacgaagcaattttacatcgtgatggaatagtaacagaaggctcttcaacaaatgtatttggcatcaaaaatggaactctctatacacatcctgcaaacaatttaattttgcgcggaattacacgcggtgttattttaacttgtgcaaaggaaatagagctaccagtagtagagcaaccatttacgacaaaacaggcgttagaaatggatgaattatttgtttcatcaacaacttctgaaattacgccggttattgagatcgatggtgtcaaaataaataatggtgttattggagaatggacacgtaaattacaaaaacaatttgaaacgaaaattccaacaccttttacgaataaataa

SEQ ID NO: 42 - protein, 283 aa, Unknown
  Obtained from environmental sample
  DOMAIN (6)...(273): Aminotransferase class IV
  SITE (190)...(193): N-glycosylation site. Prosite id = PS00001
MYSLWNDQIVKDEEVKIDKEDRGYQFGDGIYEVIKVYDGEMFTAEEHIDRFYECAEKIRLTIPYTKHKLHQLLHQLVEANELKTGHIYFQITRGVASRVHNFPAGNVQPVLSGTTKEFPRPVENFEKGVKATFTEDIRWLRCDIKSLNLLGAVLAKQEAIEKGCYEAILHRDGIVTEGSSTNVFGIKNGTLYTHPANNLILRGITRGVILTCAKEIELPVVEQPFTTKQALEMDELFVSSTTSEITPVIEIDGVKINNGVIGEWTRKLQKQFETKIPTPFTNK

SEQ ID NO: 43 - DNA, 1350 bp, Unknown
  Obtained from environmental sample
atggctctcgaacatgcctatcgtcaagcgctcccggcctcacgcgcgctctttgagcgcgcccaacacctcttcccagacggggtcactcacgataaccgccgtatgcagccttttccaatctttgtcgaacgcgccgatggtgcctacaaatgggatgtcgatggtcgacagtacatcgactactggatgggccatggcgccctcattatggggcataaccctccgcacgtgcgtgatgccgtcattgagcaggcggcgcgtggcacgcattacggcgccagccatgctctcgaagtatcatgggccgaatgggtctgcaagctggtgccatgtgctgagcgcgtacgcttcacggcctcgggcactgaggcgacgcatatggccctgcgtctggcccgcgcctatacgggcaagcgcaatgtcatcaaattcgccgggcacttccacggctggcacgagggtctagaagtgggtgtgcaaaccccctatgagatggtgccagagccagggcaaatgcaagaggcggtggacgcagtcgccctgtgccccccgaatgatatcgaggctgtccgggctgccctcgccgctggcgacgtggccgctatcatcctcgaacctacgggtggccactttggcacggtgccggtggcgccagattttttacagcgtctacgcgaagaagccaccagggccggagtcgtactcattttcgacgaggtagtgacaggttttcgcgttgcgccaggcggggctcaggaactctacggggttacgcctgacctctccacgttcgccaaaattctcgctggtggtctaccaggtggggctgtcgctggccgcgccgagatttttcattatctggcgacgcctacaaccactgaggtgggaaagcgtgcgaagattcaccatcctggcacgttcaacgccaaccctctctcggccgcggccggtgtggccatgctgtcgtccctggccgatggtacccccatcaagcgcgccaacgagcaggctgccaagctgcggcacggcatgaacgatatcctggcacgcgaaaaagtcgcctggaaggtctacggccagcacagcgattggaagctgttctatggggctgacgccccaccgcgtgacggcgctgaccagtccgtggatgacatcccctggcagcgtcttgatggcaaattcccacagcagagccgggccatgcggcaggcgctcattttacagggcgtcgattttaacggcgcacgtgctctggtgggtacctgccatactgatgatgtggtcgctgatacgctagcgggctttgcagaggcggtgcgggccgtcaaagctgacgggctcgcgtaa

SEQ ID NO: 44 - protein, 449 aa, Unknown
  Obtained from environmental sample
  DOMAIN (42)...(375): Aminotransferase class-III
MALEHAYRQALPASRALFERAQHLFPDGVTHDNRRMQPFPIFVERADGAYKWDVDGRQYIDYWMGHGALIMGHNPPHVRDAVIEQAARGTHYGASHALEVSWAEWVCKLVPCAERVRFTASGTEATHMALRLARAYTGKRNVIKFAGHFHGWHEGLEVGVQTPYEMVPEPGQMQEAVDAVALCPPNDIEAVRAALAAGDVAAIILEPTGGHFGTVPVAPDFLQRLREEATRAGVVLIFDEVVTGFRVAPGGAQELYGVTPDLSTFAKILAGGLPGGAVAGRAEIFHYLATPTTTEVGKRAKIHHPGTFNANPLSAAAGVAMLSSLADGTPIKRANEQAAKLRHGMNDILAREKVAWKVYGQHSDWKLFYGADAPPRDGADQSVDDIPWQRLDGKFPQQSRAMRQALILQGVDFNGARALVGTCHTDDVVADTLAGFAEAVRAVKADGLA

SEQ ID NO: 45 - DNA, 1167 bp, Unknown
  Obtained from environmental sample
atgacgaagcatcgcaaggctcgcttgcgccgccaaggtctgacggctaatcacggcccgacttttcgcacttcggagcctgccttgaccgctcaagtgaataccaagccccgcggccgccagttcttcaacaatccgggtccgaccaacattcccgaccgcatcctgcgggcgatggatcgtccggtgatggatttcctcgcgccggaattcctcgagatgcaccgtgcctgctacgccggcatgaagcgcatcttcaagaccgaccaggagatctacttccacgcttcgaccggccacggcgcctgggaagcggcggtcgccaacctgttctcgccgggcgacctcgtgctggtgatcgagaccggctacttctcgctgggcttcaaggagctcgccgagacgatcggcctcaaggtcgaggtcgtcggcgccgactggcgcaagggtctcgagttcgcgaagctctccgagcgcctcgccgccgacaagggccacgagatcaaggccatcctcgccgtccacaacgagaccgcgaccggcatggtgctgccgctcgccgaggtccgccgcgcgatggaccagaccaagcatccggcgctgctgctcagtgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaagtccaagctgcccaagtactacttcaactgggagctgatggaggcccgcaagccgcagcgcttcatcggcaccgtgccggtccacttcttcttcggcctcaccgagtcgatcaagatgatcgaggaagagacgctggaaggcgtgttcgcccgtcacgcccgcctcgccgaggcgacccgcgccgcggtgcgcgcctggggcaaggacggcaagggtccgtcgctctacggccagaccgaggaccgtctctcgaactcggtcaccacggtgatgatgcccgagggtcacacctcggacgccatgcgcaagatcgcgctcgagcgcttcaacctgtcgctcggcggcggcctcggcccgctgatgggcaaggtgttccgcatcggccatctcggcgacctcaacgct

SEQ ID NO: 46 - protein, 389 aa, Unknown
  Obtained from environmental sample
  DOMAIN (41)...(387): Aminotransferase class-V
  SITE (178)...(181): N-glycosylation site. Prosite id = PS00001
  SITE (369)...(372): N-glycosylation site. Prosite id = PS00001
MTKHRKARLRRQGLTANHGPTFRTSEPALTAQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETIGLKVEVVGADWRKGLEFAKLSERLAADKGHEIKAILAVHNETATGMVLPLAEVRRAMDQTKHPALLLSDTISSLGSMEYKMDAWGIDVTIAGSQKGLMLPTGMAITGVSKKALEASRKSKLPKYYFNWELMEARKPQRFIGTVPVHFFFGLTESIKMIEEETLEGVFARHARLAEATRAAVRAWGKDGKGPSLYGQTEDRLSNSVTTVMMPEGHTSDAMRKIALERFNLSLGGGLGPLMGKVFRIGHLGDLNA

SEQ ID NO: 47 - DNA, 1401 bp, Unknown
  Obtained from environmental sample
atgagcacccccccgaccaatccgccgaccaattcggcgatcatcacggactacaaggcgcggacccaggggtccggtgcgctgtttgagcgcgcccgcaaggtgctgcccagcggcatcacgcacgatgcgcgctatctcgacccgtactcgatccacgtcgccaaggccaagggcgcccgcaagtgggatgtcgatggcaacgagtatgtggactatttcggcggccatggcgccatgctgctcggccattcgcacccggcggtggtcgaggcggtgcagaagcagatggagctcggcacgcactatggctcgagccatgagctggaggtgcgctgggccgagctggtctgcgagctgacgccgtgcgccgagaaggtgcgctttaccgcgtcgggcaccgaggcctcgcacatggcgatccgcctggcgcgcgcctacaccggcaaggacaagatcgtgcgtttcatcggccacttccacggctggcacgacaacgtgacggccggcgccggcgccacctacgacggtggcaccacgccgggcgtgccgcaggacgtgagcgcgctctcgatcgtgatgccgagcgacaacgtcgccgcggtggtgaagctgatcgaggagcgtgacgacatcgccgccgtgatgttcgagccgtcaggcgcctcgtggggccaggcgcccttgccgccgggcttcatccaggcggtgcgcgacgccacgaagaagaagggcgtcatcatgctgatggacgaggtgatcaccggctatcgctggtcgtccggcggcgcgcagaaggcgttcggcatcacgcccgacctctgcatccaggccaagatcgtcgccggcggcctgccgggcggcgcggtcgcgggcaagcgcgacatcctcgaccgcatcgatcacgacgccacggcggcgaagaagatcgagcgtatcctccatcccggcacctacaacgccaatcccttgtccgccgcggcggcggtgacggcgctcacgctggtgcgcgaccaggacctcgccgagaaggccaacaagacggcggccgaattgcgcaaggcgctgaccgaggtgctggtgaaggaaggcgtgccgtggggcatctacggccagagctcgaccttcctgatctatcccaacccgttcaacgatccgatcgatcccgcgaccttcgatccgctgaaggtgccgttcgccaagctcaagggcgcgcgcggtgcgggtccgctcaccggcaagatccgcatgggcctgatgacccatggcgtcgatgtcatgggcgcgcccggcggcttcgtctcggcgacccatggcggcgccgaaatcgagaggacggtgcacgcgctgcgcgagaccgtccgcgcgctcaaggccgagcgtgaagtgaaggcggcctaa

SEQ ID NO: 48 - protein, 466 aa, Unknown
  Obtained from environmental sample
  DOMAIN (53)...(371): Aminotransferase class-III
  SITE (168)...(171): N-glycosylation site. Prosite id = PS00001
  SITE (351)...(354): N-glycosylation site. Prosite id = PS00001
MSTPPTNPPTNSAIITDYKARTQGSGALFERARKVLPSGITHDARYLDPYSIHVAKAKGARKWDVDGNEYVDYFGGHGAMLLGHSHPAVVEAVQKQMELGTHYGSSHELEVRWAELVCELTPCAEKVRFTASGTEASHMAIRLARAYTGKDKIVRFIGHFHGWHDNVTAGAGATYDGGTTPGVPQDVSALSIVMPSDNVAAVVKLIEERDDIAAVMFEPSGASWGQAPLPPGFIQAVRDATKKKGVIMLMDEVITGYRWSSGGAQKAFGITPDLCIQAKIVAGGLPGGAVAGKRDILDRIDHDATAAKKIERILHPGTYNANPLSAAAAVTALTLVRDQDLAEKANKTAAELRKALTEVLVKEGVPWGIYGQSSTFLIYPNPFNDPIDPATFDPLKVPFAKLKGARGAGPLTGKIRMGLMTHGVDVMGAPGGFVSATHGGAEIERTVHALRETVRALKAEREVKAA

SEQ ID NO: 49 - DNA, 1353 bp, Unknown
  Obtained from environmental sample
gtgagcatcctcagcacctacgaagcgaagcaccccacctcggccgagctgcaccggcaggcgcaggggatattcccggacggcgtcacgcacgatgcccgctacttcacgcccttcccgatctacgcggagcggtcgcagggcagccacaagtgggacgtggacgggaacgagtacatcgactacgtctccggtcatggcgccctgctgctcggccacggtcgggcagaggtgacgcaggctgtggcacaacagatcgcgcggggcacgcacctcggggcatcgacgccgctggagatcgagtggggtcgctgggttcagcggttgatcccgagcgcggaacgggtgcgtttcaccagttcgggtaccgaagccgtgcaaatggctgtgcggctggcccgggccttcaccggccgcgacctgctgatcaagttcgagggacatttcaacggctggagcgacaccgtctccgccaacctgctcgcgggccacgacggtcccgcctgcgtcggcgtgcctgacgcggccaccggcctccaactgatcctccctcagaacgacatcccggccttcaccctggcgatggaggagcacgcgggcagggtcgccgccgtgatcctggagccgacgggcgcctcgatgggtggaatcccgatcgagccggagttcctcttcgccctccgggagcagacggagcgcaccggcacgctcctgatcttcgacgaggtcgtgaccggcttccggatcgcgccgggcggtacgcaggcgtacttcggcatcacgccggacctgaccacactcgccaagatcctggcgggaggtctgcccggcggcgccgtcggcggacgagcggagattctgggccagattgagttcaacccggagcactccccagcgggccgtatcgcccaccctggcacgttcaacgcgaacccgctctccgctgcggcgggcgcggcggcgctggcgatcgtcgccacgggcgagccgcaccggcgggcgaacgccgccgccgccaccctggcgcgggagatgaacgatgccctcgcgcggcgggagatcgacggctgcgtctacggcctcggctcgctgctgcacatcctgctgggcaagccgtgcgctcgtcccgaggacgggctgacctgggtctgggagggagagcaccgctcggccgtgccgcgtacgtcgccggagctggtcacggccttccgccgcggcatgctcaaccacggcgtcgatccgatggccacccggttgatcgtcggcgcggagcactcggacagcgacgtggccgccacgatcaccgcgttcgaggcgacgctggacgagatgcgggaggagcagttcctgtag

SEQ ID NO: 50 - protein, 450 aa, Unknown
  Obtained from environmental sample
  DOMAIN (42)...(371): Aminotransferase class-III
MSILSTYEAKHPTSAELHRQAQGIFPDGVTHDARYFTPFPIYAERSQGSHKWDVDGNEYIDYVSGHGALLLGHGRAEVTQAVAQQIARGTHLGASTPLEIEWGRWVQRLIPSAERVRFTSSGTEAVQMAVRLARAFTGRDLLIKFEGHFNGWSDTVSANLLAGHDGPACVGVPDAATGLQLILPQNDIPAFTLAMEEHAGRVAAVILEPTGASMGGIPIEPEFLFALREQTERTGTLLIFDEVVTGFRIAPGGTQAYFGITPDLTTLAKILAGGLPGGAVGGRAEILGQIEFNPEHSPAGRIAHPGTFNANPLSAAAGAAALAIVATGEPHRRANAAAATLAREMNDALARREIDGCVYGLGSLLHILLGKPCARPEDGLTWVWEGEHRSAVPRTSPELVTAFRRGMLNHGVDPMATRLIVGAEHSDSDVAATITAFEATLDEMREEQFL

SEQ ID NO: 51 - DNA, 1344 bp, Unknown
  Obtained from environmental sample
atgacccaaccgacaccgactgccaccgtgctcgacacctaccgcacgctccacccgaagtcgggcgccctctacgagcgggcgcgcgccgtcatcgcgggcgggatcacccacgacggccgccatctctcgccgtttccgctctacgtcgagcgcgccctcggcccgcggaagtgggacgtggacggccgcgagtacatcgactactggatgggccacggcgcgctctttctcggccactgccaccccgccgtggtcaaggccgtccaggaacaggttgcgcgcggaacccacctgggcgcctcccacgagctcgaggtgcggtgggcggagctgatcaccaagctcgtgccctccgccgaaatggtccgcttcaccatgtccggcacggaggcgacgcacctcgcccttcgcatcgcgcgcgccttcacggggcgccccaaggtggtgaagttccacggccacttccacggctggcacgacggcgtggtggcggcggtcaacccgcccttcgacgtgccgatgtcggctggcgtccccgccgccactctcgatcagctgctgctggccccgcccaatgacatcaaggcagtggagatgctgctcgagcgcggcgacgtggcggcggtgatcctcgagcccgcgggcggccagtcgggaaccacgcccaccatccccggctatctgcaggagctgcggagtctctgcacgcgtcactccgtcgtcctgatcttcgacgaggtcatcaccggcttccgctactcgcccggcggcgcccaggcgtacttcggcgtgacccccgacatgacgacgctcgccaagatcgtcgcgggcggcctcccgggggcggcggtggtggggcgcaagcccatcatgtcgatgatggcgcaccggggcgatcccgcgtgggatcggagtgagcgcgtcgcccagaacgggaccttcaactccagccccgtctgcgccgccgccgccatcgccaccctcgagctcgtgagcgacggctcgctgcacgcccgcgccaacaagctcggcgacgagctccgcaccggtgtcaccgaggtgatgaagcgcgccggtatccccgggacctgcttcggcgaggcgtcgattttccacgtgtccttcgagggcaagccgggcctcgccggcttcgaccgcccgcggcgcggcgacctctaccagcgcctgcgctgcgccctgatcaacaacggggtggactgcgcgagccagcacgggtgggtctccgccgttcacaccgacgccgacatcgagcaaacgatcgccgcccacggcaaggcgttcgcggccatggccgccgacggcagcttccgggggatgtga

SEQ ID NO: 52 - protein, 447 aa, Unknown
  Obtained from environmental sample
  DOMAIN (49)...(375): Aminotransferase class-III
  SITE (167)...(173): N-6 Adenine-specific DNA methylases signature. Prosite id = PS00092
  SITE (316)...(319): N-glycosylation site. Prosite id = PS00001
MTQPTPTATVLDTYRTLHPKSGALYERARAVIAGGITHDGRHLSPFPLYVERALGPRKWDVDGREYIDYWMGHGALFLGHCHPAVVKAVQEQVARGTHLGASHELEVRWAELITKLVPSAEMVRFTMSGTEATHLALRIARAFTGRPKVVKFHGHFHGWHDGVVAAVNPPFDVPMSAGVPAATLDQLLLAPPNDIKAVEMLLERGDVAAVILEPAGGQSGTTPTIPGYLQELRSLCTRHSVVLIFDEVITGFRYSPGGAQAYFGVTPDMTTLAKIVAGGLPGAAVVGRKPIMSMMAHRGDPAWDRSERVAQNGTFNSSPVCAAAAIATLELVSDGSLHARANKLGDELRTGVTEVMKRAGIPGTCFGEASIFHVSFEGKPGLAGFDRPRRGDLYQRLRCALINNGVDCASQHGWVSAVHTDADIEQTIAAHGKAFAAMAADGSFRGM

SEQ ID NO: 53 - DNA, 861 bp, Unknown
  Obtained from environmental sample
atgaaaatgatcggatattataacggagtgcttggcaatctgcaggaaatgcagattccgatgcaggatcgggcgctgtatttcggagacggcgtctatgatttcactcctgcctacaacggcaaactgtttgccatcgaagaccatctcgaccgttttttccattccatggaaatgctgtcgatccgcccttactgtgatcgggaaactctgaagaaggaactggaacgctgcgtggcggcgacggaaagcacggaaccgatggcggtttactggcagacttcccgcggcaactgccggcgcaatcatatttttccgccggagggaacaccgactacgcttctgatcacggtcacaccattgaaaccgctggatccgaatgtatcactgaagctggcttcgtttgaagacaagcgttttcagtactgcaatatcaagacactgaatctgattcccaatgttctggccgcgcagtacgcggaagagcagggatgtcaggaagctgtgttccaccgcggtaagtttgtaatggaatgcgcccacagttcactcgtcctgctgaaggacggtgtactgatggcaccgccgctcgatgacaggatactgccgtccatcacccgcaaacatatcacggccatctgcaaaacactggatgttccggtcgaggaaagaaagatcacgatggatgaactgtatgaagcggacgaactgatcgttctgagttccagcaagctgattgcccgggccaatgtactggatggcaaaccggtcggcatgagtgactccatgctgttcacgatgatccgagacgcatatttcaggatggtcgaaaaagaaaccggctatcgtatcggagagtga

SEQ ID NO: 54 - protein, 286 aa, Unknown
  Obtained from environmental sample
  DOMAIN (8)...(273): Aminotransferase class IV
  SITE (128)...(131): N-glycosylation site. Prosite id = PS00001
MKMIGYYNGVLGNLQEMQIPMQDRALYFGDGVYDFTPAYNGKLFAIEDHLDRFFHSMEMLSIRPYCDRETLKKELERCVAATESTEPMAVYWQTSRGNCRRNHIFPPEGTPTTLLITVTPLKPLDPNVSLKLASFEDKRFQYCNIKTLNLIPNVLAAQYAEEQGCQEAVFHRGKFVMECAHSSLVLLKDGVLMAPPLDDRILPSITRKHITAICKTLDVPVEERKITMDELYEADELIVLSSSKLIARANVLDGKPVGMSDSMLFTMIRDAYFRMVEKETGYRIGE

SEQ ID NO: 55 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaacccatgtacgtgacctacgaagccgtg

SEQ ID NO: 56 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYADVRGKVALRQAIANRHRQRSGQAVNAGQVTVLAGAQCALFCVAQCVLDPGDEVIVAEPMYVTYEAV

SEQ ID NO: 57 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgagcccatgtacgtcacttacgaaggcgtg

SEQ ID NO: 58 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYADVRGKVALRQAIANRHRQRSGQAVNAGQVTVLAGAQCALFCVAQCVLDPGDEVIVAEPMYVTYEGV

SEQ ID NO: 59 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacactgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaacccatgtatgtgacctacgaaggcgtg

SEQ ID NO: 60 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYTDVRGKVALRQAIANRHRQRSGQAVNAGQVTVLAGAQCALFCVAQCVLDPGDEVIVAEPMYVTYEGV

SEQ ID NO: 61 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaaccgatgtacgtgacctacgaggccgtg

SEQ ID NO: 62 - protein, 132 aa, Unknown; identical to SEQ ID NO: 56
  Obtained from environmental sample

SEQ ID NO: 63 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagcggccaagcggtgaaagccgagcaggtgacggtactggcaggggcgcagtgcgcgctgttctgcgtggcccagtgcgtgcttgacccgggggatgaagtgatcgttgccgaaccgatgtacgtcacctacgagggcgtg

SEQ ID NO: 64 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIANRHRLRSGQAVKAEQVTVLAGAQCALFCVAQCVLDPGDEVIVAEPMYVTYEGV

SEQ ID NO: 65 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatcctcctgctgtcggtcggcgatccggatttcgatacgccgcagcccatcgtgcaggcggctgtggatagcctgcgtgctggcgccacccattacgccgatgtcagcggcaagcgtgccctgcgcgaggccattgctgctcgtcacgggaagcgcagcggccagttggtggacgccgatcaggtgatcgtgctcgccggtgcccagtgcgcgctctacgcagtggcccagtgcgtgctgaatccgggcgacgaggtaatcgtcgccgagcccatgtacgtgacctatgaggccgtg

SEQ ID NO: 66 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRSGQLVDADQVIVLAGAQCALYAVAQCVLNPGDEVIVAEPMYVTYEAV

SEQ ID NO: 67 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatcctcctgctgtcggtcggcgatccggatttcgatacgccgcagcccatcgtgcaggcggctgtggatagcctgcgtgctggcgccacccattacgccgatgtcagcggcaagcgtgccttgcgcgaggccattgctgctcgtcacgggaagcgcagcggccagttggtggacgccgatcaggtgatcgtgctcgccggcgcccagtgcgcgctctacgcagtggcccagtacgtgctgaatccgggcgacgaggtaatcgtcgccgagccgatgtatgtgacttacgaagccgtg

SEQ ID NO: 68 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRSGQLVDADQVIVLAGAQCALYAVAQYVLNPGDEVIVAEPMYVTYEAV

SEQ ID NO: 69 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatccttctgctgtcggtcggcgatccggatttcgatacgccgcagcccatcgtgcaggcggctgtggatagcctgcgtgctggcgccacccattacgccgatgtcagcggcaagcgtgccctgcgcgaggccattgctgctcgtcacgggaagcgcggcggccagttggtggacgccgatcaggtgatcgtactcgctggcgcccagtgcgcgctctacgcagtggcccagtgcgtgctgaatccgggcgacgaggtaatcgtcgccgagccgatgtatgtgacctatgaagccgtg

SEQ ID NO: 70 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRGGQLVDADQVIVLAGAQCALYAVAQCVLNPGDEVIVAEPMYVTYEAV

SEQ ID NO: 71 - DNA, 396 bp, Unknown
  Obtained from environmental sample
atgcgctacgccaagctcactcaacgcatcgccggcgacggggctgcggcctgggacatccactaccgcgccctggcgctgcaggccgagggcagggatatcctgctgctgtcggtgggtgacccggacttcgacacccccgcgccgatcgtcgaggcggccatcgacagcctgcgtgcaggccatacccattacgccgatgtgcgcggcaagctggcgctgcgccaggccatcgccaaccgccaccggcagcgcagcggccaggccgtcgatgccgaccaggtgacggtgctggcgggggcccaatgtgcgctgtactgcgtggcccagtgcgtgctcgacccgggtgacgaggtgattgtcgccgagccgatgtacgtgacttacgaggccgtg

SEQ ID NO: 72 - protein, 132 aa, Unknown
  Obtained from environmental sample
MRYAKLTQRIAGDGAAAWDIHYRALALQAEGRDILLLSVGDPDFDTPAPIVEAAIDSLRAGHTHYADVRGKLALRQAIANRHRQRSGQAVDADQVTVLAGAQCALYCVAQCVLDPGDEVIVAEPMYVTYEAV

SEQ ID NO: 73 - DNA, 396 bp, Unknown
  Obtained from environmental sample
atgcgctacgccaagctcactcaacgcatcgccggcgacggggctgcggcctgggacatccactaccgcgccctggcgctgcaggccgagggcaaggatatcctgctgctgtcggtgggtgacccggacttcgacacccccgcgccgatcgtcgaggcggccgtcgacagcctgcgtgcgggccacacccattacgctgatgtgcgcggcaagctggcgctgcgccaggccatcgccaaccgccaccggcagcgcagcggccaggccgtcgatgccgaccaggtgacggtgctggcgggggcccagtgcgcgctgtactgcgtggcccagtgcgtgctcgacccgggcgacgaggtgattgtcgccgagcccatgtacgtgacctatgaggccgtg

SEQ ID NO: 74 - protein, 132 aa, Unknown
  Obtained from environmental sample
MRYAKLTQRIAGDGAAAWDIHYRALALQAEGKDILLLSVGDPDFDTPAPIVEAAVDSLRAGHTHYADVRGKLALRQAIANRHRQRSGQAVDADQVTVLAGAQCALYCVAQCVLDPGDEVIVAEPMYVTYEAV

SEQ ID NO: 75 - DNA, 873 bp, Unknown
  Obtained from environmental sample
atgagcacagtatatttaaatggccagtttatgccggccagcgaagcgcggatttcaccaatggatcgtggctttttatttggtgacggaatctatgaggtgatcccaacctatcacggtcgttatgttggctttgcgccgcatatcgcacggatgcatgaaggcttagctgcacttaatattcagcatggtatgaccgagcagcgctggcgcgagctttgcgatcagctgctcgagctaaaccggccagaactgggtgagaatttgggcgtttatattcaggtcagccgcggtgccgataccaaacgcaaccatgcctttccaagtggtatcagcccaaccatttttgcctatacctttgccatcgccgccgagccggtgccggataaaagcaaggtcagcacctatagtgtggttaccgccaacgacttacgctggcagcgctgccatattaaatccacctctttgctgggtaatgtgctgcattatcaatacggcgtggaacagggcgcgcaggaaaccctgctatttgaccgcgacggcaacttaaccgaaggcgcggcagtaaatgtatttgtggtaaaaaacggcgaaattgctaccccgccgctaagtaataagctgttacccggtgtcacccgcttactgctgctggcgatcctgcgccaacactcggatttaaaggtggtagagcgtgagattagcttcgacgaagtattggctgccgatgaaatctggctaaccagctccagtaaagaaattgcgccggtagttaaggttaatggccagccggtgggggatggcactgtgggtgatatctggctggcggcgcagcggttgtttagtgagcataagtatagtgttgagtgttga

SEQ ID NO: 76 - protein, 290 aa, Unknown
  Obtained from environmental sample
  DOMAIN (7)...(282): Aminotransferase class IV
  SITE (184)...(187): N-glycosylation site. Prosite id = PS00001
MSTVYLNGQFMPASEARISPMDRGFLFGDGIYEVIPTYHGRYVGFAPHIARMHEGLAALNIQHGMTEQRWRELCDQLLELNRPELGENLGVYIQVSRGADTKRNHAFPSGISPTIFAYTFAIAAEPVPDKSKVSTYSVVTANDLRWQRCHIKSTSLLGNVLHYQYGVEQGAQETLLFDRDGNLTEGAAVNVFVVKNGEIATPPLSNKLLPGVTRLLLLAILRQHSDLKVVEREISFDEVLAADEIWLTSSSKEIAPVVKVNGQPVGDGTVGDIWLAAQRLFSEHKYSVEC

SEQ ID NO: 77 - DNA, 873 bp, Unknown; identical to SEQ ID NO: 75
  Obtained from environmental sample

SEQ ID NO: 78 - protein, 290 aa, Unknown; identical to SEQ ID NO: 76
  Obtained from environmental sample
  DOMAIN (7)...(282): Aminotransferase class IV
  SITE (184)...(187): N-glycosylation site. Prosite id = PS00001

SEQ ID NO: 79 - DNA, 396 bp, Unknown
  Obtained from environmental sample
atgcgctacgccaagcttacccaacgcatcgccggcgacggggctgcggcctgggacatccactaccgcgccctggcgctgcaggccgagggcaaggacatcctgctgctgtcggtgggtgacccggacttcgacacccccggcccgattgtcgaggcggccatcgacagcctgcgtgcaggccacacccattacgccgatgtacgcggcaagctggccctgcgccaggccatcgccaagcgccaccagcagcgtagcggccaggccgtcaacgccgaccaggtgacggtgctggcgggcgctcagtgcgcgctgtactgcgtggcccagtgcgtgctggacccaggcgacgaggtgcttgtcgccgaacccatgtacgtcacctcgaagccgtga

SEQ ID NO: 80 - protein, 131 aa, Unknown
  Obtained from environmental sample
MRYAKLTQRIAGDGAAAWDIHYRALALQAEGKDILLLSVGDPDFDTPGPIVEAAIDSLRAGHTHYADVRGKLALRQAIAKRHQQRSGQAVNADQVTVLAGAQCALYCVAQCVLDPGDEVLVAEPMYVTSKP

SEQ ID NO: 81 - DNA, 393 bp, Unknown
  Obtained from environmental sample
atgcgctacgccaagcttacccaacgcatcgccggcgacggggctgcggcctgggacatccactaccgcgccctggcgctgcaggccgagggcaaggacatcctgctgctgtcggtgggtgacccggacttcgacacccccggcccgattgtcgaggcggccatcgacagcctgcgtgcaggccacacccattacgccgatgtacgcggcaagctggccctgcgccaggccatcgccaagcgccaccagcagcgtagcggccaggccgtcaacgccgaccaggtgacggtgctggcgggcgctcagtgcgcgctgtactgcgtggcccagtgcgtgctggacccaggcgacgaggtgcttgtcgccgaacccatgtacgtcacttatgaggca

SEQ ID NO: 82 - protein, 131 aa, Unknown
  Obtained from environmental sample
MRYAKLTQRIAGDGAAAWDIHYRALALQAEGKDILLLSVGDPDFDTPGPIVEAAIDSLRAGHTHYADVRGKLALRQAIAKRHQQRSGQAVNADQVTVLAGAQCALYCVAQCVLDPGDEVLVAEPMYVTYEA

SEQ ID NO: 83 - DNA, 1398 bp, Unknown
  Obtained from environmental sample
atgagcaccccgaccaatccggcgaccaattcggccatcgtcaccgactacaaggcacggacccagggctcgggtgcgctgtttgaacgcgcccgcaaggtgctcccgagcggcatcacgcacgatgcgcgctatctcgacccctattcgatccacgtcgccaaggccaagggcccgcgcaaatgggacgtcgatggcaacgaatatgtggactatttcggtggccacggcgccatgctgctcggccattcgcaccccgcggtgatcgaggcggtcaagaagcagatggagctgggcacgcactacggctcgagccacgagctcgaggtgcgctgggccgagctggtgtgcgagctgacgccctgtgccgagaaggtgcgcttcaccgcctcgggcaccgaggcgtcgcacatggcgatacgtttggcgcgtgcctacaccggcaaggagaagatcgtccgcttcatcggccacttccacggctggcacgacaacgtcacagccggcgcgggcgcgacctacgacggcggcaccacgccgggcgtgccgcaggaggtgagctctctttcgatcgtcatgccgagcgacaacgtcgccgcggtcgtgaagctgatcgaggagcgcgacgacatcgccgcggtgatgttcgagccgtccggcgcctcgtggggccaggcgccgctgccgccgggcttcatccaggcggtgcgcgacgccacggccaagaagggcgtcgtcatgctgatggacgaggtcatcaccggctatcgctggtcgtcgggcggcgcgcagaaggcgttcggcatcacgcccgacctctgcatccaggccaagatcgtcgccggcggcctgccgggcggcgcggtcgcgggcaagcgcgagatcctcgatcgcatcgatcacgatgcgacggcggccaagaagatcgagcgcatcctccatcccggcacctacaacgccaacccgttgtcggccgccgcggcggtgacggcgctcaccctagtgcgcgacgaggatctctcggagaaggccaacaagaccgcggccgagctgcgcgcggcgctcaccgaggtgctggtgaaggagagcgtgccgtggggcatctacggccagagctcgaccttcctgatctatcccaacccgttcaacgatccggtcgatcccgcgaccttcgatccgctcaaggtgccgttcgccaagctcaagggtgcgcgcggcgcgggtccgctcaccggcaagatccgcatgggcctgatgacccacggcgtcgacgtgatgggcgcgcccggcggcttcgtctcggcgacccacggcggcggcgagatcgagaagaccgtccacgccttgcgcgagacggtgcgcgcgctcaaggccgagcgggaagtgaaagccgcctga

SEQ ID NO: 84 - protein, 465 aa, Unknown
  Obtained from environmental sample
  DOMAIN (52)...(365): Aminotransferase class-III
  SITE (167)...(170): N-glycosylation site. Prosite id = PS00001
  SITE (350)...(353): N-glycosylation site. Prosite id = PS00001
MSTPTNPATNSAIVTDYKARTQGSGALFERARKVLPSGITHDARYLDPYSIHVAKAKGPRKWDVDGNEYVDYFGGHGAMLLGHSHPAVIEAVKKQMELGTHYGSSHELEVRWAELVCELTPCAEKVRFTASGTEASHMAIRLARAYTGKEKIVRFIGHFHGWHDNVTAGAGATYDGGTTPGVPQEVSSLSIVMPSDNVAAVVKLIEERDDIAAVMFEPSGASWGQAPLPPGFIQAVRDATAKKGVVMLMDEVITGYRWSSGGAQKAFGITPDLCIQAKIVAGGLPGGAVAGKREILDRIDHDATAAKKIERILHPGTYNANPLSAAAAVTALTLVRDEDLSEKANKTAAELRAALTEVLVKESVPWGIYGQSSTFLIYPNPFNDPVDPATFDPLKVPFAKLKGARGAGPLTGKIRMGLMTHGVDVMGAPGGFVSATHGGGEIEKTVHALRETVRALKAEREVKAA

SEQ ID NO: 85 - DNA, 873 bp, Unknown
  Obtained from environmental sample
atgagcacgttgccgatctgctatctgaacggcgattatctgccgctcaccgaggcgcgggtgtcgcccctcgatcgggcattcctgttcggggacgcggtctacgaggtcgtcatggtggcgggtgcgcgcccgtttcgcctgcaacagcatctcgatcgcctccagcgcagtctcgccggcatccgcatgacgccacccctcgagcacgaggcctggggccgcatttgcgccgagctgatcgagcgcaatgacgccgagaatgcccacatctacatgcaggtcacccgcggtgcagagctcgggcgcaatcacgcgtggccggacggactgccgcccacggtgttcgcctacgccagcgtcatggagcccttgagccgcgcggcgctcgacaacggcgtcaccgcgatcaccgccgcggacacccgttgggcccggcgtgacatcaagtccaccgcattgctcgccaacgtgctcttgaagaggctggccgtggatgccggcgcgttcgagaccatcctgctcgagaacggcgagctcaacgaaggctcatccaccacggttcatgtggtcaagagcggacggatcgcctgtccgccgaacgggacgcatattctcccgggaaccacccgcgatgtggtgacggagctcgcgcagcgcaacggcattcccacggaaagccgccgcgtcaaggagtcggagctgcgcgatgccgacgagatatggctggctttctccacccgcggcttgttgccggtgacccggctcgacggcgcggcggtcgggtccggcaagccggggccgctgttcaagcgggttcacgacgcgttcgagcggcatctcgtcgagcttcgggggacgccggcgctgtag

SEQ ID NO: 86 - protein, 290 aa, Unknown
  Obtained from environmental sample
  DOMAIN (10)...(278): Aminotransferase class IV
  SITE (204)...(207): N-glycosylation site. Prosite id = PS00001
MSTLPICYLNGDYLPLTEARVSPLDRAFLFGDAVYEVVMVAGARPFRLQQHLDRLQRSLAGIRMTPPLEHEAWGRICAELIERNDAENAHIYMQVTRGAELGRNHAWPDGLPPTVFAYASVMEPLSRAALDNGVTAITAADTRWARRDIKSTALLANVLLKRLAVDAGAFETILLENGELNEGSSTTVHVVKSGRIACPPNGTHILPGTTRDVVTELAQRNGIPTESRRVKESELRDADEIWLAFSTRGLLPVTRLDGAAVGSGKPGPLFKRVHDAFERHLVELRGTPAL

SEQ ID NO: 87 - DNA, 879 bp, Unknown
  Obtained from environmental sample
gtggtttatctgaacgggcgttttgtccccatggaggaagccgtcgttcccatcgaggaccgcggctaccaatttgctgatggtgtctacgatgttttgaaatttcacgggcgttgcgctgtgcggctgacggcccacctcgaacgtcttgcggaaagctgcgcggggttgcgcattgaaggcgtgccttcggcccaggggtggcgctccatcatcgcggagttggccgagcgcagcgaacttggccacacgtttgacgacactgtcattctctacattcaggttacgcgaggagtggcttcgcgcattcactatttccccgagccgcgccccaagcccacggtcctggcctatttcaaagcggctcccgtttaccccgaggcattgcgtcgcgacggggcctcagtgatcacgatgcccgatgagcgctggggtcgctgtcacatcaagagcattgcccttttgcctgtcgtcctggccaagcaagcggcgcgcgaggccggtgctctcgaggcgcttctcgtgcgcgacgggatcgtgactgagggcggcgcgtcgaatgccttctgtgtgcgccagggagtcatcttcacgcacccggagggcccccgcattctctcaggggtcacgcgcggcattgttctcgatgcagcacgacgccttggcattgaggtgcgtgaggagcccgttcccatcgaagagttccgtgcggcggacgaggcgtttctttcgagcacaaccatgaacgtcatgcctgtgacgcgtatcaatggcgctcccgtcggaagcggagctgttggggaagtcacgcgctccatcgcggcggcggtcgaagaactcattcgggaggagcatgaagccaacgcgtccctcggatga

SEQ ID NO: 88 - protein, 292 aa, Unknown
  Obtained from environmental sample
  DOMAIN (5)...(278): Aminotransferase class IV
  SITE (292)...(295): N-glycosylation site. Prosite id = PS00001
MVYLNGRFVPMEEAVVPIEDRGYQFADGVYDVLKFHGRCAVRLTAHLERLAESCAGLRIEGVPSAQGWRSIIAELAERSELGHTFDDTVILYIQVTRGVASRIHYFPEPRPKPTVLAYFKAAPVYPEALRRDGASVITMPDERWGRCHIKSIALLPVVLAKQAAREAGALEALLVRDGIVTEGGASNAFCVRQGVIFTHPEGPRILSGVTRGIVLDAARRLGIEVREEPVPIEEFRAADEAFLSSTTMNVMPVTRINGAPVGSGAVGEVTRSIAAAVEELIREEHEANASLG

SEQ ID NO: 89 - DNA, 396 bp, Unknown
  Obtained from environmental sample
atgcgctttgccaagctgacccaacgcattgccggcgacggcgccgccgcctgggacatccactaccgcgccctggcgatgcaggccgagggcaaggacgtcctgctgctgtcggtgggggacccggatttcgacacgccggcgcccatcgtcgaggcagccatcgacagcctgcgcgatggtcacacccattactccgacgtgcgcggcaagctggccttgcgccaggcgatcgcccgtcgtcaccagcagcgcagtggccaggcggttagcgccgaccaggtcacggtgctggccggtgcgcagtgcgcgctgttctgcgtggcccaatgcgtgctcgatccgggcgacgaggtgatcgtcgccgagcccatgtatgtcacctacgaagccgtg

SEQ ID NO: 90 - protein, 132 aa, Unknown
  Obtained from environmental sample
MRFAKLTQRIAGDGAAAWDIHYRALAMQAEGKDVLLLSVGDPDFDTPAPIVEAAIDSLRDGHTHYSDVRGKLALRQAIARRHQQRSGQAVSADQVTVLAGAQCALFCVAQCVLDPGDEVIVAEPMYVTYEAV

SEQ ID NO: 91 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtatgtcacctatgagggcgtg

SEQ ID NO: 92 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIADRHRLRSGQAVKAEQVTVLAGAQCALFCVAQCVLDPGDEVIVAEPMYVTYEGV

SEQ ID NO: 93 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtacgtgacttacgaaggcgtg

SEQ ID NO: 94 - protein, 132 aa, Unknown; identical to SEQ ID NO: 92
  Obtained from environmental sample

SEQ ID NO: 95 - DNA, 396 bp, Unknown
  Obtained from environmental sample
atgcgctacgccaagctcacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctatgaaggcgtg

SEQ ID NO: 96 - protein, 132 aa, Unknown; identical to SEQ ID NO: 92
  Obtained from environmental sample

SEQ ID NO: 97 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctacgaggccgtg

SEQ ID NO: 98 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIADRHRLRSGQAVKAEQVTVLAGAQCALFCVAQCVLDPGDEVIVAEPMYVTYEAV

SEQ ID NO: 99 - DNA, 390 bp, Unknown
  Obtained from environmental sample
atgcgctacgccacgctcacccaacgcatcgccggcgacggggctgcggcctgggacatccactaccgcgccctggcgctgcaggccgagggcaaggacatcctgttgctgtcggtgggtgacccggacttcgacacccctgcgccgattgtccaggcggccatcgacagcctgcgagcgggccacacccattacgccgatgtgcgcggcaagctggccctgcgccaggccattgccaaccgccaccggcagcgcagcggccaagccgtcagtgcggaccaggtgacggtgctggcaggtgcgcagtgtgcgttgtactgcgtcgcccagtgcgtcctggacccaggcgacgaagtgctcgtcgccgagccgatgtacgtcacctacgag

SEQ ID NO: 100 - protein, 130 aa, Unknown
  Obtained from environmental sample
MRYATLTQRIAGDGAAAWDIHYRALALQAEGKDILLLSVGDPDFDTPAPIVQAAIDSLRAGHTHYADVRGKLALRQAIANRHRQRSGQAVSADQVTVLAGAQCALYCVAQCVLDPGDEVLVAEPMYVTYE

SEQ ID NO: 101 - DNA, 396 bp, Unknown
  Obtained from environmental sample
atgcgctacgccaagctcactcaacgcatcgccggcgacggggccgcagcctgggacatccactaccgcgccctggcgctgcaggccgagggcaaggatatcctgctgctgtcggtgggtgacccggacttcgacacccccgcgccgatcgtcgaggcggccatcgacagcctgcgagcgggccacacccattacgccgatgtgcgcggcaagctggcgctgcgccaggccatcgccaaccgccaccgccagcgcagcggccaggccgtcgatgccgaccaggtgacggtgctggcgggagcccaatgtgcgctgtactgcgtggcccagtgcgtgctcgacccgggtgacgaagtgattgtcgccgagcccatgtacgtgacctacgaagcgtga

SEQ ID NO: 102 - protein, 131 aa, Unknown
  Obtained from environmental sample
MRYAKLTQRIAGDGAAAWDIHYRALALQAEGKDILLLSVGDPDFDTPAPIVEAAIDSLRAGHTHYADVRGKLALRQAIANRHRQRSGQAVDADQVTVLAGAQCALYCVAQCVLDPGDEVIVAEPMYVTYEA

SEQ ID NO: 103 - DNA, 396 bp, Unknown
  Obtained from environmental sample
atgcgctacgccaagctcactcaacgcatcgccggcgacggggctgccgcctgggacatccactatcgcgccctggcactgcaggccgagggcaaggacatcctgctactgtcggtgggtgacccggacttcgacacccccgcgccgatcgtcgaggcggccatcgacagcctgcgtgcaggccacacccattacgccgatgtgcgcggcaagctggcgctgcgccaggccatcgccaagcgccaccgacagcgcagcggccaggcggtcgatgccgtccaggtgacggtgctggcgggggcgcagtgcgcgctgtactgcgtggcccagtgcctgctcgacccgggtgacgaggtgatcgtcgccgagccgatgtacgtcacctacgaaggcgtg

SEQ ID NO: 104 - protein, 132 aa, Unknown
  Obtained from environmental sample
MRYAKLTQRIAGDGAAAWDIHYRALALQAEGKDILLLSVGDPDFDTPAPIVEAAIDSLRAGHTHYADVRGKLALRQAIAKRHRQRSGQAVDAVQVTVLAGAQCALYCVAQCLLDPGDEVIVAEPMYVTYEGV

SEQ ID NO: 105 - DNA, 396 bp, Unknown
  Obtained from environmental sample
atgcgctacgccaagctcactcaacgcatcgccggcgacggggccgcggcctgggacatccactaccgcgccctggcgctgcaggccgagggcaaggacgtcctgctgctgtcggtgggtgacccggacttcgacacccccgcgccgatcgtcgaggcggccatcgacagcctgcatgcgggcaatacccattatgccgatgtgcgcggcaagctggcgctgcgccaggcaatcgccaaccgccaccggcagcgcagcggccaggccgtcgatgccgaccaggtgacggtgctggcgggggcccaatgcgcgctgtactgcgtggcccagtgcgtgctcgacccgggtgacgaggtgattgtcgccgagcccatgtacgtcacctacgaaggcgtg

SEQ ID NO: 106 - protein, 132 aa, Unknown
  Obtained from environmental sample
MRYAKLTQRIAGDGAAAWDIHYRALALQAEGKDVLLLSVGDPDFDTPAPIVEAAIDSLHAGNTHYADVRGKLALRQAIANRHRQRSGQAVDADQVTVLAGAQCALYCVAQCVLDPGDEVIVAEPMYVTYEGV

SEQ ID NO: 107 - DNA, 396 bp, Unknown
  Obtained from environmental sample
atgcgctacgccaagctcacccaacgcatcgccggcgacggggctgctgcctgggacatccgctaccgcgccctggcgctgcaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagtggccaagcggtgaacgccgagcaggtgacggtactggcaggtgcgcagtgcgcgctgttctgcgtggcccagtgcgtgcttgacccgggcgatgaagtgatcgttgccgaaccgatgtacgtcacctacgaaggcgtg

SEQ ID NO: 108 - protein, 132 aa, Unknown
  Obtained from environmental sample
MRYAKLTQRIAGDGAAAWDIRYRALALQAEGKDILLLSVGDPDFDTPTPIVEAAIDSLRAGHTHYADVRGKQALRQAIANRHRLRSGQAVNAEQVTVLAGAQCALFCVAQCVLDPGDEVIVAEPMYVTYEGV

SEQ ID NO: 109 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggcgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagcggccaagcggtgaaagccgagcaggtgacggtactggcaggggcgcagtgcgcgctgttctgcgtggcccagtgcgtgcttgacccgggggatgaagtgatcgttgccgaacccatgtacgtcacctacgaaggcgtg

SEQ ID NO: 110 - protein, 132 aa, Unknown; identical to SEQ ID NO: 64
  Obtained from environmental sample

SEQ ID NO: 111 - DNA, 396 bp, Unknown
  Obtained from environmental sample
atgcgctacgccaagctcacccaacgcatcgccggcgacggggctgctgcctgggacatccactaccgcgccctggcgctgcaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagtggccaagcggtgaacgccgagcaggtgacggtactggcaggtgcgcagtgcgcgctgttctgcgtggcccagtgcgtgcttgacccgggcgatgaagtgatcgttgccgaaccgatgtacgtgacctacgaagccgtg

SEQ ID NO: 112 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIANRHRLRSGQAVNAEQVTVLAGAQCALFCVAQCVLDPGDEVIVAEPMYVTYEAV

SEQ ID NO: 113 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgatgaagtgatcgttgccgaacccatgtacgtcacctacgaggccgtg

SEQ ID NO: 114 - protein, 132 aa, Unknown; identical to SEQ ID NO: 98
  Obtained from environmental sample

SEQ ID NO: 115 - DNA, 390 bp, Unknown
  Obtained from environmental sample
atgcgctacgccaagctcactcaacgcatcgccggcgacggggctgccgcctgggacatccactaccgcgccctggcgctgcaggccgagggcaaggacatcctgctgctgtcggtgggtgacccggacttcgacacccccgcgccgatcgtcgaggcggccatcgccagcctgcgtgcaggccacacccattacgccgatgtgcgcggcaagctggcgctgcgccaggccatcgccaagcgccaccggcagcgtagcggccaggcggtcgatgccgaccaggtgacggtgctggcgggggcgcagtgcgcgttgtactgcgtggcccagtgcctgctcgacccgggtgacgaggtgatcgtcgccgagcccatgtacgtgacttacgaa

SEQ ID NO: 116 - protein, 130 aa, Unknown
  Obtained from environmental sample
MRYAKLTQRIAGDGAAAWDIHYRALALQAEGKDILLLSVGDPDFDTPAPIVEAAIASLRAGHTHYADVRGKLALRQAIAKRHRQRSGQAVDADQVTVLAGAQCALYCVAQCLLDPGDEVIVAEPMYVTYE

SEQ ID NO: 117 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtacgtgacctacgagggcgtg

SEQ ID NO: 118 - protein, 132 aa, Unknown; identical to SEQ ID NO: 92
  Obtained from environmental sample

SEQ ID NO: 119 - DNA, 396 bp, Unknown; identical to SEQ ID NO: 97
  Obtained from environmental sample

SEQ ID NO: 120 - protein, 132 aa, Unknown; identical to SEQ ID NO: 98
  Obtained from environmental sample

SEQ ID NO: 121 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctacgaaggcgtg

SEQ ID NO: 122 - protein, 132 aa, Unknown; identical to SEQ ID NO: 92
  Obtained from environmental sample

SEQ ID NO: 123 - DNA, 396 bp, Unknown
  Obtained from environmental sample
atgcgctacgccaagcttacccaacgcatcgccggcgatggggctgcggcctgggacattcactaccgcgccctggcgctacaggccgagggcaaggacatcctgctgctgtcggtgggtgacccggatttcgacacccccgcgccaattgtcgaggcagccatcgacagcctgcaggccggtcatacccattacgccgatgtacgcggcaagccggccctgcgccaggccatcgccaaccgccaccggcaacgcagcggccaggcggtcgatgccgaccatgtgaccgtgctggctggggcccagtgcgcgttgtattgcgtggcccagtgcgtgctggacccaggtgacgaggtgcttgttgccgaaccgatgtacgtcacctacgaaggcgtg

SEQ ID NO: 124 - protein, 132 aa, Unknown
  Obtained from environmental sample
MRYAKLTQRIAGDGAAAWDIHYRALALQAEGKDILLLSVGDPDFDTPAPIVEAAIDSLQAGHTHYADVRGKPALRQAIANRHRQRSGQAVDADHVTVLAGAQCALYCVAQCVLDPGDEVLVAEPMYVTYEGV

SEQ ID NO: 125 - DNA, 831 bp, Unknown
  Obtained from environmental sample
atggcggctgacgtggtctggctcaacggggccgtcgtgcccgccgccgaggcgacggtctccatcttcgaccacggcctcacggtgggcgacggcgtgttcgagacgctcaaggcgaccgccggggtgcccttcgcggcgcgccgccacctcgagcggctccggcgctccgccgacgggttggggctgaaggtgccgtggaccgacgacgacctgcgggccgcgatggaggccgtgctggccgggctcgacctgcccctggcccgggtccgcatcaccgtcaccggcggcgccgcccccctcggctccgatcgcggggacgggccgcccacggtcgtcgtggccggcgggccgctggcccggcccgcgcccaccaccgacgtctgcacggtgccgtggccccgcaacgagcgcggcgccctcgccggcctcaagaccacctcctacgccgagaacgtccgggccctggccgtcgccaaggagcagggctgcaccgaggcgctctacgccacgacgacgggcctcctctgcgagggcaccggcgccaacctcttcctcgtccacgagggccgcctcgtcacgccgacgctcgccagcggctgcctggccggggtcacccgcgccctggtcctggaggtcaccgacgccgtcgaggtcgacctgccggcggaggcgctggctggcgccagcgaggcgttcctcacgtcgacgggccgtgacgtgcaggccatcgcgcacgtcgacggccgcgcctacgacgcgccgggcccgcagacggccgcggccgcgaaggccctcgccgcgctggaggccagcaaccccgacccctag

SEQ ID NO: 126 - protein, 276 aa, Unknown
  Obtained from environmental sample
  DOMAIN (9)...(267): Aminotransferase class IV
MAADVVWLNGAVVPAAEATVSIFDHGLTVGDGVFETLKATAGVPFAARRHLERLRRSADGLGLKVPWTDDDLRAAMEAVLAGLDLPLARVRITVTGGAAPLGSDRGDGPPTVVVAGGPLARPAPTTDVCTVPWPRNERGALAGLKTTSYAENVRALAVAKEQGCTEALYATTTGLLCEGTGANLFLVHEGRLVTPTLASGCLAGVTRALVLEVTDAVEVDLPAEALAGASEAFLTSTGRDVQAIAHVDGRAYDAPGPQTAAAAKALAALEASNPDP

SEQ ID NO: 127 - DNA, 1362 bp, Unknown
  Obtained from environmental sample
atgtccgtggcgacggctcgaccgaccctgacggaacgctaccaaaccgagttcgccaactcgcgcaaactcttcgagcaggcgaagacggtattccccaacggggtcacccatgaccttcgccacctggaaccgttccccatctacgtcgaacgcgccgccggcgcctacaagtgggacgtcgatggccatcagctgatcgacttatggtccggccacggtgccctgctgctcgggcacagccatccggaaattgtcgaggcggtgcagcggcagatggcccgctcgacgcatcccggcgcctgtcatgagctggaaattgagtggggccaatgggtgcagaagctggtgccgtcggcggagcgggttcgcttcacctcatcgggcaccgaagcaaccttgatggccctgcggctggcgcgcatcttcacgggccggccgcgggtgctcaagtttgccgggcatttccacggctggcacgatttcgtcattccggccgcggacccgccctacgacggcagccccgtgcccggcgtgccgcgcgaggtggcggccgatacgctgatcgttccgcccaacgacccggccgccgtcgatcggatgttggcgagcgatccacagattggatgcgtcatcctcgaaccgacgggcggccatttcggcgcagtccctattcgtggcgagttcctgcgggcgctgcgcgaactgacgagcaagcacggccgactgctgatcttcgacgaggtcatcagcggtttccgtgtgcatccgggcggcgcccagggactctacggtgtcaaaccggacctgacgactctggccaaggtcctggccggcggattgcccggcggctgtctggcagggcgggccgacgtactcgcgggcctggagtttcgaccgggcaaaccgaagatgaagcatcccggcacgttcaacgccaatccactctcagccgcagcgggtgtgacggccctgcgcctggtagcgagcggggagccctgccggcgagcgaacgagacgggccggttgctccggaaaaacctaaacgcgctattcaccgcgcgcggcgtggactgggtggcttacggcgagttctcgggtatcaagctgctgaccggctaccagggaccgcggccgaccggtgatgatttcattccttatggcggcgccgtggacaagttggacgggcctcgaaacggcaaacttgtgcacgcgttccggcgtggaatgctactgcacggcgtggacgtgccgggacttggcggcatgacgacgacggcgcacaccgaggccgacatcgagaagacggtgggcgcggtggcgggaacgctggatctgttgcgcgaggagggcttgatgtag

SEQ ID NO: 128 - protein, 453 aa, Unknown
  Obtained from environmental sample
  DOMAIN (49)...(372): Aminotransferase class-III
  SITE (343)...(346): N-glycosylation site. Prosite id = PS00001
MSVATARPTLTERYQTEFANSRKLFEQAKTVFPNGVTHDLRHLEPFPIYVERAAGAYKWDVDGHQLIDLWSGHGALLLGHSHPEIVEAVQRQMARSTHPGACHELEIEWGQWVQKLVPSAERVRFTSSGTEATLMALRLARIFTGRPRVLKFAGHFHGWHDFVIPAADPPYDGSPVPGVPREVAADTLIVPPNDPAAVDRMLASDPQIGCVILEPTGGHFGAVPIRGEFLRALRELTSKHGRLLIFDEVISGFRVHPGGAQGLYGVKPDLTTLAKVLAGGLPGGCLAGRADVLAGLEFRPGKPKMKHPGTFNANPLSAAAGVTALRLVASGEPCRRANETGRLLRKNLNALFTARGVDWVAYGEFSGIKLLTGYQGPRPTGDDFIPYGGAVDKLDGPRNGKLVHAFRRGMLLHGVDVPGLGGMTTTAHTEADIEKTVGAVAGTLDLLREEGLM

SEQ ID NO: 129 - DNA, 864 bp, Unknown
  Obtained from environmental sample
atgcgtaccgtctatgtgaatggcaaatttctgcccgaggccgagggtatggtttcgatcttcgatcgcggcttcaccatgagcgacagtgtctacgaagtgaccggcgtcgtcgccggcaagatgctcgacttcgaccctcatatggcccgcctgcagcgctccatgagcgagctcggcatgccaaaaggccccggggccgatgccttaaaggcaattcatctgaagatgatcgagctgaacaaactcgacgaaggcctggtctatctccagattacccgcggggtgcaggaccgcaatttcgagcttcccgcagcagacaaccccttgaccatcgtgctgttcacccaggcgcgcccggtggtggaatctgcgcaggccgagcgcggcatcaaggtcatcagcctgccggatctgcgctggcaccgcagcgacatcaagacgacgcagctcctctatgcctgccttgccaaggacgcagcgaagaagcggggctgcgacgatgcctggctggtgcgcgacggtctggtgaccgagggcagcgccaacaatgccttcattgtcacgcgggacggacttgtcatcacgcgtgacctttccaccgagcttcttcccggcattacccgcaagcggatcgtcgagctggcggcaaatcacggctatcgcctcgaacaacgtgccttcaccattgccgaggcgaaggccgcggtcgaagccttcatcacctcggcaacgcagttcgtcatgccggtggtggaaatcgacggcgcggcaattggccagggcaagccaggcaaattcagtgttgcacttcgcaagctttacatcgaagaaacgctgtcgcgcgccgggatcaggcgatga

SEQ ID NO: 130 - protein, 287 aa, Unknown
  Obtained from environmental sample
  DOMAIN (7)...(276): Aminotransferase class IV
MRTVYVNGKFLPEAEGMVSIFDRGFTMSDSVYEVTGVVAGKMLDFDPHMARLQRSMSELGMPKGPGADALKAIHLKMIELNKLDEGLVYLQITRGVQDRNFELPAADNPLTIVLFTQARPVVESAQAERGIKVISLPDLRWHRSDIKTTQLLYACLAKDAAKKRGCDDAWLVRDGLVTEGSANNAFIVTRDGLVITRDLSTELLPGITRKRIVELAANHGYRLEQRAFTIAEAKAAVEAFITSATQFVMPVVEIDGAAIGQGKPGKFSVALRKLYIEETLSRAGIRR

SEQ ID NO: 131 - DNA, 855 bp, Unknown
  Obtained from environmental sample
atggcatattcattatggaatgatcaaattgtggaagaaggatccattgcggtatcaccagaagatagaggctatcaatttggtgacggcatttatgaagtaatcaaagtttataacggaaatatgtttacagcacaagagcatattgatcgtttctatgcaagcgccgaaaaaattcgtcttgttattccttatacaaaagacgttttacacaaattattacatgagctaattgaaaaaaataatctagatacagggcatgtttatttccaaatcacacgtggtgccaattcacgtaatcacgttttcccagatgcaagtgttccagctgtattaacaggtaatgtaaaagcgggtgaacgtgcatatgagaactttgaaaaaggggtaaaggctacgtttgtagaggatattcgttggttacgctgtgatattaaatcgttaaacttacttggtgcagtattagcaaaacaagaggctgctgaaaagggctgctatgaagcgattttacatcgtggggatatcgtaacagaatgctcatcagcaaatgtttatgggattaaagacggtaagctttatacacatccagcaaataacttcattttaaacggtattactcgtcaagtgattttgaaatgtgcagaggagattagtttacctgtcgtggaagaaccaatgacaaaagctgatttattaacaatggatgaaatcattgtatcatctgtatcttctgaagttacacctgttattgatgtggatggtaaccaaattggtgcaggagtgccaggtgaatggacgcgtaaattgcaacaagcttttgaggcgaaattaccactttctttgaatacaaaataa

SEQ ID NO: 132 - protein, 284 aa, Unknown
  Obtained from environmental sample
  DOMAIN (7)...(274): Aminotransferase class IV
MAYSLWNDQIVEEGSIAVSPEDRGYQFGDGIYEVIKVYNGNMFTAQEHIDRFYASAEKIRLVIPYTKDVLHKLLHELIEKNNLDTGHVYFQITRGANSRNHVFPDASVPAVLTGNVKAGERAYENFEKGVKATFVEDIRWLRCDIKSLNLLGAVLAKQEAAEKGCYEAILHRGDIVTECSSANVYGIKDGKLYTHPANNFILNGITRQVILKCAEEISLPVVEEPMTKADLLTMDEIIVSSVSSEVTPVIDVDGNQIGAGVPGEWTRKLQQAFEAKLPLSLNTK

SEQ ID NO: 133 - DNA, 876 bp, Unknown
  Obtained from environmental sample
atgagcggaccgctcccgatctgctacctgaacggcgagttcttgccgttgcgcgacgcccgtgtatcgcccttggaccgcgccttcctgttcggcgatgcggtgtacgaggtggtgccggtctacgatgcgcgcccgttccggctgcgccagcacctggagcgcctcgaccgcagcctcgccggcatccgcatgccgccggccctgccgcacggcgactgggcacacatctgccaggagctgatccgccgcaacgacgccgacgaggcctacgtatacatgcaggtgagccgcggtgcggagtatggccgcaatcacgcctggcccgaggacttgaagcccaccctgttcgcctatatttcggcgatggacgggctctcgaacgccctcatcgagaagggcgtggccgcggtgaccgccaaggaaatccgctgggcgcgtcgcgacatcaagtcgaccgcgctattgggcaatattctcttgaagaagctggcgcaggagcgcggcgccttcgagaccatcatgctggagaacggcgaattgaccgagggctcatccaccaccgtgcacgtgatcaagaacggcatcattcacacgccgccgaacggccagaagatactgcccggcaccacgcgcgatgtggtgaccgagcttgccgggttgctgtccatcccctgcaagagcgcgccggtgagcgaagcggagctgcgcgcagcggacgagatctggctcgcctttgccacccgcggggtgcttgccgtgacggcgcttgacggcgagccggtgggcggcggcaaaccgggtccgctgttcgctcgcatgcgactcgcgttcgccaactatgcacgcgacctcaagggcagtccggcgctatga

SEQ ID NO: 134 - protein, 291 aa, Unknown
  Obtained from environmental sample
  DOMAIN (11)...(279): Aminotransferase class IV
MSGPLPICYLNGEFLPLRDARVSPLDRAFLFGDAVYEVVPVYDARPFRLRQHLERLDRSLAGIRMPPALPHGDWAHICQELIRRNDADEAYVYMQVSRGAEYGRNHAWPEDLKPTLFAYISAMDGLSNALIEKGVAAVTAKEIRWARRDIKSTALLGNILLKKLAQERGAFETIMLENGELTEGSSTTVHVIKNGIIHTPPNGQKILPGTTRDVVTELAGLLSIPCKSAPVSEAELRAADEIWLAFATRGVLAVTALDGEPVGGGKPGPLFARMRLAFANYARDLKGSPAL

SEQ ID NO: 135 - DNA, 864 bp, Unknown; identical to SEQ ID NO: 129
  Obtained from environmental sample

SEQ ID NO: 136 - protein, 287 aa, Unknown; identical to SEQ ID NO: 130
  Obtained from environmental sample
  DOMAIN (7)...(276): Aminotransferase class IV

SEQ ID NO: 137 - DNA, 1386 bp, Unknown
  Obtained from environmental sample
atgcctgacaccaacctgacgaactcgaagatcgtcgcggcctatcgcgagcgcacaccgggctcagcgagccttgcggccaaggcgcaggagctgctgccgagcggcatcgcccacgacgcccgcttcatgaagccctacggcatctatgtcgagcgagccaagggcccgcgcaaatgggacgtggacggcaacgagtacgtcgactatttcggcggacacggcgcgttgctcctcgggcacaaccatccgagcgttgtggccgcgagccacgcggcgctcgagcaaggcacgcatttcggcgccaatcatccgcgcgaggtccgctgggccgaactggtgcgcaagctggtcccctcggcggagagcgtgcgcttcacctcgtccgggaccgaggccacgttgatggcggtgcggctttcgcgctcggtcaccggcaagcccaaagtcgtgcgcttcctgacgcatttccacggctggcacgaccacatgacctcgggccacgccaaccatttcgacggcacgccgacggcgggcgtgctggccggcgtcgccgagcacgtgatcctgctgccgcctggcgacgtcgaagcggtaaagagcacgttcgccagccgcaacgacatcgcctgcgtgatcctggagccgaccggcacgagcttcggcgcggcgccgctgccgccgtccttcctccgcgtcctgcgcgaggagaccgagaagcacgggatcttcctgatcttcgacgaggtggtgacgggatttcgcgtctcgcccggcggcgcgcaaggcgagttcggcatcaagcccgacctgacgtcgctcgccaagatcctggcgggcggattgcccggcggcgcggtcgtgggccggcgcgacattctggacgacctcgacttcgacgcggtcgagcgcaagaagcgcgagaagatcgcgcaccccggcacctacaatgctaatccgctatccgccgccgccggcatcgccgcgctggagatcgtcggcaccggcgagccctgcaagcgggccagcgccacggccgcctcgctccgcgcggcgctcaacgacgtactggcggaggagcgcgtaccttgggcggtctacggctccttcagcggattccatttcttcctgaatgcgaagcagcgggcggtcgacccgttgcgcttcgatccgatgacgctcgactacaaagagctgctgagcaatccacccgcgctcgcgcgcttgctgcgcctggcgctcctcgccaacggcgtcgacgtcaacggccgggcaagcggcttcacctccgcggcgcatgggcctgcggagatcgaggaaaccgcccgtgcgctccgccagagtctccgcatgctgcgcgccgagggcgagctgccggctcgataa

SEQ ID NO: 138 - protein, 461 aa, Unknown
  Obtained from environmental sample
  DOMAIN (50)...(377): Aminotransferase class-III
  SITE (5)...(8): N-glycosylation site. Prosite id = PS00001
MPDTNLTNSKIVAAYRERTPGSASLAAKAQELLPSGIAHDARFMKPYGIYVERAKGPRKWDVDGNEYVDYFGGHGALLLGHNHPSVVAASHAALEQGTHFGANHPREVRWAELVRKLVPSAESVRFTSSGTEATLMAVRLSRSVTGKPKVVRFLTHFHGWHDHMTSGHANHFDGTPTAGVLAGVAEHVILLPPGDVEAVKSTFASRNDIACVILEPTGTSFGAAPLPPSFLRVLREETEKHGIFLIFDEVVTGFRVSPGGAQGEFGIKPDLTSLAKILAGGLPGGAVVGRRDILDDLDFDAVERKKREKIAHPGTYNANPLSAAAGIAALEIVGTGEPCKRASATAASLRAALNDVLAEERVPWAVYGSFSGFHFFLNAKQRAVDPLRFDPMTLDYKELLSNPPALARLLRLALLANGVDVNGRASGFTSAAHGPAEIEETARALRQSLRMLRAEGELPAR

SEQ ID NO: 139 - DNA, 1383 bp, Unknown
  Obtained from environmental sample
atgcccgatacgctgacgacaaactcgccgatcatctccgcctaccgcgccgcgacacccggctcggccgagcacgcgcaacgcgccgccgagatgttcccctccggcatcacccacgattcgcgctacatcgagccctacgggatctacattgcgcgcgcccaggggccgcgcaaatgggatgtcgacgggcgctgctatgtcgattatttcggcggccatggtgcgctgctgctcggccattgccatcccgaagtgatggcggcggtacacgcccaactcgaccgcgggacccattacggcgccagccacgagctggagatcgaatgggccgagcgggtcaaggcgctgatcccgaccgccgagcgcgtgcgtttcacctcatcgggcaccgaggcgacgctgatggcggtgcgcctcgcgcgcgccttcaccggcaagccgaagctgatccgcttcaactaccatttccacggctggcacgaccacatgacgtccggccacgcgaaccatttcgacgggacgccgacgaccggcgtgctcgacgcggtggccggcaacgtccttctgtgcgaccagaatgacgaggcggcgctggcgcggctgctcgaccggcatcacggcgagatcgccgcggcgatcatcgagccgactggcgccaacggcggcaaattgccgatcgacccggatttcctccaggcgctgcgccggctcaccagcgagcatggcgtgctgttgatctttgacgaggtggtgaacggtttccgggtcgcgccaggcggcgcgcaggaggcctacggcatccggcccgatctcacaaccctggcgaaaatcctcgccggcggactgccgggcggcgccgtaaccggcagaaaggacatcctcgacctcctcgacttccaggttaccaaaggcgccggcaaggagaagatcaaccatcccggcacattcaacgccaacccgctgtcggccgccgccgggattgccgccctcaagatcgtgcgcgagagcgacgcctgcgcccgcgccaaccattacggcgacgagctgcgccgccggctcaacgaggtgtttgaggaggagcggatgccgtgggccgcgtacggcaccttctcgacccttgaattgttcaccaaccccgagggcaaaaagatctcgccgagcaccttcgatccgctagaggaatcgttcgccagcctcaaaggcgagcgcaacgccggcatcatccacaagctgcgcctcggcatgatgatccacggcgtcgacttgtcgagccatccgggcggcgtcatctcgtgcacgcacggcgaagccgagatggaggacaccgtcaaggcgatgcgaagcaccgtgcgcatgctgcgcgccgagggtgagctgtag

SEQ ID NO: 140 - protein, 460 aa, Unknown
  Obtained from environmental sample
  DOMAIN (50)...(378): Aminotransferase class-III
MPDTLTTNSPIISAYRAATPGSAEHAQRAAEMFPSGITHDSRYIEPYGIYIARAQGPRKWDVDGRCYVDYFGGHGALLLGHCHPEVMAAVHAQLDRGTHYGASHELEIEWAERVKALIPTAERVRFTSSGTEATLMAVRLARAFTGKPKLIRFNYHFHGWHDHMTSGHANHFDGTPTTGVLDAVAGNVLLCDQNDEAALARLLDRHHGEIAAAIIEPTGANGGKLPIDPDFLQALRRLTSEHGVLLIFDEVVNGFRVAPGGAQEAYGIRPDLTTLAKILAGGLPGGAVTGRKDILDLLDFQVTKGAGKEKINHPGTFNANPLSAAAGIAALKIVRESDACARANHYGDELRRRLNEVFEEERMPWAAYGTFSTLELFTNPEGKKISPSTFDPLEESFASLKGERNAGIIHKLRLGMMIHGVDLSSHPGGVISCTHGEAEMEDTVKAMRSTVRMLRAEGEL

SEQ ID NO: 141 - DNA, 855 bp, Unknown
  Obtained from environmental sample
atgacgcgtattgtttatttaaatggtgaatacctgccggacagtgaagcgaaaatttcgatttttgaccgcgccgtgaccttcggcgacgccatctacgatgtcgccggagtgctcgacggcaagctggtcgacttcgagcaccacatgcagcgctacttcaactcgctgcgcaaactggggatcgagtcaccgttgagccaggacgaaatcctcgctgcgtttcgcgaactggtggcgaagaacgaattggacgaaggtctggtgtacatgcaggtcacccgaggcaccgccgagcgcgatttcgactggccggaaggaatccagcccaacgtgttcatgttcacccaggtcaaggactcgatggaaaacgaggcagccgagactggcgtcgggctcgcgtccaccgacgatatccgctgggcccgccgcgatatcaagtcggtcaacctgctcgggcaggtgctggccaagcacaaggcgcacgaggccggcgcctacgaggcgctgatgatcgaccgcgagggttacgtgaccgaatgcggcagcaccagttttttcatcgtgcgtgacaggcgtatcctgacccgaccgctgagcaacgacattctgcccggcgtcacgcgccgcgcgctggttgcgctgtgcgaacgcgattcgctcgacctggaggaatgccgatttaccctcgaagacgcgctgggtgccgacgaggccttcatcagcggggcatcgagttacgtgctaccggtaaaagaaatcgacggtcagaagatcggcagcgaaatgccgggaccagtcacccgccacatgcgcgagatctatctcgacttcgtccgcgccagcctgatctag

SEQ ID NO: 142 - protein, 284 aa, Unknown
  Obtained from environmental sample
  DOMAIN (8)...(276): Aminotransferase class IV
MTRIVYLNGEYLPDSEAKISIFDRAVTFGDAIYDVAGVLDGKLVDFEHHMQRYFNSLRKLGIESPLSQDEILAAFRELVAKNELDEGLVYMQVTRGTAERDFDWPEGIQPNVFMFTQVKDSMENEAAETGVGLASTDDIRWARRDIKSVNLLGQVLAKHKAHEAGAYEALMIDREGYVTECGSTSFFIVRDRRILTRPLSNDILPGVTRRALVALCERDSLDLEECRFTLEDALGADEAFISGASSYVLPVKEIDGQKIGSEMPGPVTRHMREIYLDFVRASLI

SEQ ID NO: 143 - DNA, 915 bp, Unknown
  Obtained from environmental sample
atgaaaggaaatactaatgccgacctttcctcagtggatctgcccggggcaggttctacagccgtgtatcctaccaaggtatttctgaatggcagcatagtcgatgctgaaaacgcaaaggtttccgtctttgatcggggttttatctttggcgacgggatctatgaagtaatggcccggatcaatggcgttttcttctatggcgatgcccattgggaacgattggaaacctgcctgcagaagatcggcctggtctacgacatatcaattctaaaggacgcgatcccggaattgctggaagcatccggaataggtcaggaagattgtatggtctatatccaggtaaccaggggaacggcccccaggcagcatggctaccctcccagcccccaacccactgcaatgatgtacgcctggaagaagaccctcccggccattgaaacaaagcattcccgtgtagttaccctggaggattttcgttggtctcgctgcgatattaaaatgacgtccctcttgggcaatgtcatggcaaacgaatgggccatggagaacgaggcctacgaaaccgtcctgatccgaaatggcgtagccacagaggcatcccactgtaatgttttcttcgtgaaggacggtacggtatggacccaccctgcggaccatcatatcctcgacgggatcacacgccaggtagtcctggaaatttgtgaggagctcggcatcccggttagacttgagggtataccggcggataaattgaaacaaatggacgaggccttccttacgggcaccggatcacaggtacgggccatacaggagctcgacgaccatccgtattttaaaacccatccgggtcctgtaacccttcggatacaacgcacattcctagaacttaaaagcggaaagatctcgttctga

SEQ ID NO: 144 - protein, 304 aa, Unknown
  Obtained from environmental sample
  DOMAIN (30)...(295): Aminotransferase class IV
  SITE (30)...(33): N-glycosylation site. Prosite id = PS00001
  SITE (202)...(231): Aminotransferases class-IV signature. Prosite id = PS00770
MKGNTNADLSSVDLPGAGSTAVYPTKVFLNGSIVDAENAKVSVFDRGFIFGDGIYEVMARINGVFFYGDAHWERLETCLQKIGLVYDISILKDAIPELLEASGIGQEDCMVYIQVTRGTAPRQHGYPPSPQPTAMMYAWKKTLPAIETKHSRVVTLEDFRWSRCDIKMTSLLGNVMANEWAMENEAYETVLIRNGVATEASHCNVFFVKDGTVWTHPADHHILDGITRQVVLEICEELGIPVRLEGIPADKLKQMDEAFLTGTGSQVRAIQELDDHPYFKTHPGPVTLRIQRTFLELKSGKISF

SEQ ID NO: 145 - DNA, 1350 bp, Unknown
  Obtained from environmental sample
atggctctcgaacaggtctatcgtcaagcgcttccggcctcgcacgccctctttgagcgcgcccaaaaccttttccccgacggggtcacccacgacaaccgccggatgcagccttttcccatctttgtcgaacgtgccgatggggcgtacaaatgggatgccgatggccggcagtatatcgactactggatgggccatggtgcactcattatggggcataaccctccgcacgtgcgcgatgccgtcatcgagcaagcggcgcgtggcacgcactacggcgccagtcatgctctcgaagtggtatgggccgaatgggtctgtaagctggtgccctgtgctgagcgcgtgcgctttacggcctcgggcactgaggcgacgcacatggccctgcgtctggcccgcgcctatacgggcaagcggcgcgtgatcaaattcgccgggcactttcacggctggcatgagggcctggaagtgggtgtacagaccccctatgaaacagtgccagagccagggcaaatgcaagaagcggtagacgccgtcgccctgtgcccaccgaacgacattgaggccgtccgggctgcccttgccgctggtgacgtggccgctattatcctcgaacccacgggtggccactttggcacggtgccggtggcgccgggttttttacggtgtctacgggaagaagccaccagggctggggtggtgctcatcttcgacgaagtagtgacgggttttcgtgttgcgccaggcggtgcacaggaactctacggcgtcactcctgacctttcgacgtttgctaaaattctcgctggcggtctgcctggtggggctgttgctggccgggccgagatttttaactatctggcgacgccaacagccgctgagataggaaaacgtgcaaagattcaccatcccggcacgttcaacgccaatcccctctcggccgcggccggcgtggcgatgctgtcctctctggccgatggcacatgcatcaagcgcgccaacgagcaggctgccaagctacggcatggtatgaacgacatcctcgcacgcgaaaaagtcgcctggaaagtctatggccagcacagcgactggaaactgttctacggcgctggtgccccaccgcgtgatggcgctgaccagtccgtggatgacatcccctggcagcgcctggacggcaaattcccgcagcagagccgggccatgcggcaagcgctcatcctgcaaggtattgactttaacggggcgcgtgctctcgtaggtacctgccacactgacgacgtcgtcgctgagaccctggcgggctttgcagaggcggtacgggccgtcaaagccgacgggctcgcgtaa

SEQ ID NO: 146 - protein, 449 aa, Unknown
  Obtained from environmental sample
  DOMAIN (42)...(355): Aminotransferase class-III
MALEQVYRQALPASHALFERAQNLFPDGVTHDNRRMQPFPIFVERADGAYKWDADGRQYIDYWMGHGALIMGHNPPHVRDAVIEQAARGTHYGASHALEVVWAEWVCKLVPCAERVRFTASGTEATHMALRLARAYTGKRRVIKFAGHFHGWHEGLEVGVQTPYETVPEPGQMQEAVDAVALCPPNDIEAVRAALAAGDVAAIILEPTGGHFGTVPVAPGFLRCLREEATRAGVVLIFDEVVTGFRVAPGGAQELYGVTPDLSTFAKILAGGLPGGAVAGRAEIFNYLATPTAAEIGKRAKIHHPGTFNANPLSAAAGVAMLSSLADGTCIKRANEQAAKLRHGMNDILAREKVAWKVYGQHSDWKLFYGAGAPPRDGADQSVDDIPWQRLDGKFPQQSRAMRQALILQGIDFNGARALVGTCHTDDVVAETLAGFAEAVRAVKADGLA

SEQ ID NO: 147 - DNA, 1383 bp, Unknown
  Obtained from environmental sample
atggcgcaagctctcgtgacaacgacgatccaccaggactatgaaacgcggttcgctgactcgcgcgcgatgcacgagcgcgcgcggcagctcatccccggcggcatcacccacgatggccgtttcctgaagccgtttccgccctacatcgccgacgcgcaaggcgcgtacaagtggagcgtcgacggtaacaagctgatcgacttcgccatggggcacggctcgctcctctttgggcacaacgatcccgacatcgtggcggcgatgcaggcgcagctcccgcacggcacgcactacagtgccggtcacgagctggaggtgcgctgggcggaggagatcagccggctcgtcccgtccgcagagcaagtgaaattcacgggctccggcaccgaagcgacgctgctagcgatccgtgtcgcgcggtcgttcactggccgcgagacggtcgtcaagctggaaggacatttccatggctggcatgactacctcctgaaaggagagcggccgccgttcgagtcgccatccagtcccggcatcccctccgccgtgacggcgaccgtcgccgtcgttccttcagacgatctcgggatgctcgaggagcggttggcgcaaggcgatgtcgcggcgctgatcatggagccgagcggtggctcctgggcgacgatccccttccccgaagaatatctgcaggcggcgcgcgacctggccacgcgttatggggtcgtactcatcttcgacgaggtgatcaccggcttccgctgggcgcctggtggtgcgcaggagcgcttcggcgtcatcccggacctcacgaccatggccaagatcgttgccggcggcatgcccggcggtgcgctgggaggccggcgcgacatcatggaggtgctggcgttcaaggatgacgcgacgtggaacgcgacgaagaaggtccgccaccaggggacctacaacgccagcccggtcgtctgtgcggcggcgatcacctgcctgcggaaagcggccgatccatccgtacagcgctactgcgacgacctcgcggcgcggctgcgcgccggtctcaatgcggctctgatggagcgtgacgtgccaggcttctcctggggcgagagctccatcttccacgttgcgctcggggagcgcgcaccgaaccagagcggaggcgacatgcgctcaccgtccggcattgcggcagagacgctcaagtcgagcgtgcgcaccccgctcaaccagacgctccacctcgggatgcttttggcaggagtggatttcttcgccggcggtgggctgctcggccgcgcccacaccgcgcaggacatcgacgactcgatcgccgccttcggccgcgtgctcgaccgcatgcgggatgagggagcgttcgcggcgtag

SEQ ID NO: 148 - protein, 460 aa, Unknown
  Obtained from environmental sample
  DOMAIN (49)...(375): Aminotransferase class-III
  SITE (308)...(311): N-glycosylation site. Prosite id = PS00001
  SITE (387)...(390): N-glycosylation site. Prosite id = PS00001
  SITE (414)...(417): N-glycosylation site. Prosite id = PS00001
MAQALVTTTIHQDYETRFADSRAMHERARQLIPGGITHDGRFLKPFPPYIADAQGAYKWSVDGNKLIDFAMGHGSLLFGHNDPDIVAAMQAQLPHGTHYSAGHELEVRWAEEISRLVPSAEQVKFTGSGTEATLLAIRVARSFTGRETVVKLEGHFHGWHDYLLKGERPPFESPSSPGIPSAVTATVAVVPSDDLGMLEERLAQGDVAALIMEPSGGSWATIPFPEEYLQAARDLATRYGVVLIFDEVITGFRWAPGGAQERFGVIPDLTTMAKIVAGGMPGGALGGRRDIMEVLAFKDDATWNATKKVRHQGTYNASPVVCAAAITCLRKAADPSVQRYCDDLAARLRAGLNAALMERDVPGFSWGESSIFHVALGERAPNQSGGDMRSPSGIAAETLKSSVRTPLNQTLHLGMLLAGVDFFAGGGLLGRAHTAQDIDDSIAAFGRVLDRMRDEGAFAA

SEQ ID NO: 149 - DNA, 1377 bp, Unknown
  Obtained from environmental sample
atgccacaaccaaccaatcccaacccactcgaaaccgcctacacacaaactctcccaaattcccgggcgctctttgagcgcgccagcaagctctttcccgatggggtgacacacgacaatcgacgcatgcagccctttcctatctttgtggatcgtgctgatggtgcccataagtgggacatcgacggccgttgttacattgactactggatggggcacggtgcactcctcttcgggcataacccgccgcacgtccgcgacgcggtgctcgaacaagtgtcgcgtggtacacactatggtgccagccaccccctggaagtcgcctggggtgaatggatttgtcgtctggtgccctgcgccgagcgtgtacgctttaccgcctcaggcaccgaagccacccacatggcggtgcgtctggcgcgggcgtttaccggtaaaaagcgtgtgatcaaattcgccggccattttcacggctggcacgaaggtctggaagtcggcgtgcaagccccctatgagacattcccagaagctggccaactgcccgcagtggtggatgtcgtagccctgtgcccacccaacgatattgccgcggtacgggcggcactggccgctggggacgtggcagcagtaattctcgaacccaccgggggccacttcggcgccgtgccagtgacaccaggatttctggcccagctccacgacgagacgcgcaaaaccggtactgtgctgatcttcgacgaggtggtaacaggttttcgtgtagctcccggtggggcacaagaactctttggggtcacaccagacctggctacctttgccaagattcttgctggtgggctgcctggcggcgccgttgctggccgcgcagagatcatggcctacctggcgaccaaagccacaccggaggaaacccaccgtaccaaaatgccccatcctggcacattcaacgccaaccctttatcagccgccgcaggcgtggccatgctggcatcagtcgcggatggcacagccatccgcctggcgaacgcacaggcggccaagctcaggcacggcatgaacgagattctggcacgggaacaagtggcatggaaggtctatggccagcacagcgactggaaagtctactatggggctgacgccccaccacgtgatggcaatgaccaagcggtggacaacattccctggcagcgcctcgatgccaggtatcccgtgcagagccgggtactgcgacaggccatgatccttcagggaattgattttaacggcgcacgggctctagtgggtacttgccacacggacgacgtcatcgcccacaccctggagggctttgccgcggccatccgtgccgtgaaagctgcggagtcccacaggtactag

SEQ ID NO: 150 - protein, 458 aa, Unknown
  Obtained from environmental sample
  DOMAIN (49)...(367): Aminotransferase class-III
MPQPTNPNPLETAYTQTLPNSRALFERASKLFPDGVTHDNRRMQPFPIFVDRADGAHKWDIDGRCYIDYWMGHGALLFGHNPPHVRDAVLEQVSRGTHYGASHPLEVAWGEWICRLVPCAERVRFTASGTEATHMAVRLARAFTGKKRVIKFAGHFHGWHEGLEVGVQAPYETFPEAGQLPAVVDVVALCPPNDIAAVRAALAAGDVAAVILEPTGGHFGAVPVTPGFLAQLHDETRKTGTVLIFDEVVTGFRVAPGGAQELFGVTPDLATFAKILAGGLPGGAVAGRAEIMAYLATKATPEETHRTKMPHPGTFNANPLSAAAGVAMLASVADGTAIRLANAQAAKLRHGMNEILAREQVAWKVYGQHSDWKVYYGADAPPRDGNDQAVDNIPWQRLDARYPVQSRVLRQAMILQGIDFNGARALVGTCHTDDVIAHTLEGFAAAIRAVKAAESHRY

SEQ ID NO: 151 - DNA, 852 bp, Unknown
  Obtained from environmental sample
atgtccgaaattgttttcctgaacggaaggttcatctctaaaaatgaagcggttatttctcctgaagaccgtggttttaactttgccgacggcatttacgaagtcgtgaaatactacaacggaaggccttttcgatatgccgaccacatggaacgcctgcgccggagccttcgcgaagtgcaaatcgggttcaacggtaccgatctgctggaagccatttttcaggagctactgagacggaacgaccttgaacaacaggaagccggcatttacctgcagattacacgtggagctcatcagcgcatgcaccggtatcccgacaacattgaaccaactgtttatgccaccgcgttttcgtttgcgtccaaccgcgaacaacttgggtgcggcgtgaaagtgatcactactgaagatgtgcgttggcttcgctgcgacatcaaatcggtttcactgctgcccaacgcgatggcggcacagaaagcatacgaaaacgatgccgccgaagctatttttatccgcaatggtgtggtcactgaagggtcgcattccagttttatggccgtgaaaaacaatgttgtttatacacatccagactcgaacctgattttgccgggcatcacaaaaatggtagttcgggaaatttgccgcacccatcggatcgagctggtggaagaagcaattcaggcttcacagctttctgaaatggacgaaatgatgatcgtgggaaccggaagcgaagtaatgccggtagtgcagttcgaccaaataatggtgggcaatggccaacccggaccgataacacttcaacttcaggagaaattttttgaattgaccaaacaaacaaattcatag

SEQ ID NO: 152 - protein, 283 aa, Unknown
  Obtained from environmental sample
  DOMAIN (8)...(275): Aminotransferase class IV
MSEIVFLNGRFISKNEAVISPEDRGFNFADGIYEVVKYYNGRPFRYADHMERLRRSLREVQIGFNGTDLLEAIFQELLRRNDLEQQEAGIYLQITRGAHQRMHRYPDNIEPTVYATAFSFASNREQLGCGVKVITTEDVRWLRCDIKSVSLLPNAMAAQKAYENDAAEAIFIRNGVVTEGSHSSFMAVKNNVVYTHPDSNLILPGITKMVVREICRTHRIELVEEAIQASQLSEMDEMMIVGTGSEVMPVVQFDQIMVGNGQPGPITLQLQEKFFELTKQTNS

SEQ ID NO: 153 - DNA, 1269 bp, Unknown
  Obtained from environmental sample
atggaaatcgatcaggagatgtacgagcgcatggccggctcggccgcgctctacgagcgggcgaaggagacgtttcccagcggcgtcacccatgacgcccggtacgccaagccgttcccgatctacgtcacccgtgcccagggcagccgcaaatgggacgtcgatgggaacgagtacgtcgactactacggtggccacggcgcactgatcctcggacactgccacccggtcgtgacccaggccgtcgtcgagcaggctcagaaggggagccattacggcgcctgccacgagctcgagatccgctggggcgagctggtccaggagatcgttccttcggctgaggcggtcaagttcgtctcgtccggcaccgaggcgacgatgctggcgctgcggctggcccgggcgttcactggccgcgatcggatcatcaaggcgaacgggcacttccacggctggcacgactacgcggcggtggcaatggccccgccctgggacgtgccgatctcggtgggcatcccgaagggcgtccagggcacggtgactggcatcgacgacaaggacgccgatgcgctggaggccgagctggcgaagggcgacgtcgcggcggtcatcatctggtgcaacgccctcaacaaggagtgggccgagacggtccgcgacaaggcgaaggcgcacggcgccctcgtgatctacgacgaagtcgtgacgggcttccgctacgctccagggggcgcgcaggagtacttcggcgtcaagccggacctgacgacgctggcgaagatcgttgctggcgggtacccgggcggcgccattgccgggcgggatgacatcatccaccagttcgacttctcggacgatccgaagaagcagcggttcgctcggatcgcccaccccggcacctacaacgccagcccggtctcggcggcagcgggcgtggcctgcctggagatcgtcaaggacccggcgattcagcagaaggcggccgacaccgcgacgaagatcaaggctggtttcaaggaggcgctcgaccggaccggcgtcgagggctcagtgaccggctgggcatcgtatatctcgaccagcctgaaggggaaggggagcgcctggtcgctccagctcaagtggcgggcggcgatgcagcttggcggcgtcgatccgtccggcaccagcctgatcgtctcggcgatgcacgacgacgaggatgtcgagcggaccgtggccgcgtacgaggcggcgatccaccggctgcgcaacgaaaacctgatctag

SEQ ID NO: 154 - protein, 422 aa, Unknown
  Obtained from environmental sample
  DOMAIN (42)...(364): Aminotransferase class-III
MEIDQEMYERMAGSAALYERAKETFPSGVTHDARYAKPFPIYVTRAQGSRKWDVDGNEYVDYYGGHGALILGHCHPVVTQAVVEQAQKGSHYGACHELEIRWGELVQEIVPSAEAVKFVSSGTEATMLALRLARAFTGRDRIIKANGHFHGWHDYAAVAMAPPWDVPISVGIPKGVQGTVTGIDDKDADALEAELAKGDVAAVIIWCNALNKEWAETVRDKAKAHGALVIYDEVVTGFRYAPGGAQEYFGVKPDLTTLAKIVAGGYPGGAIAGRDDIIHQFDFSDDPKKQRFARIAHPGTYNASPVSAAAGVACLEIVKDPAIQQKAADTATKIKAGFKEALDRTGVEGSVTGWASYISTSLKGKGSAWSLQLKWRAAMQLGGVDPSGTSLIVSAMHDDEDVERTVAAYEAAIHRLRNENLI

SEQ ID NO: 155 - DNA, 1362 bp, Unknown
  Obtained from environmental sample
aagaattcgccgatcatcgccgcctaccgtgccgcgaccccgggctcggccgccgccgccgagaaggcgagccgactgttccccagcgggatcacccatgattcccgctatatcgagccctacgggctctacatcacccgcgctcaggggccgcgcaaatgggacgtcgacggcaactgctatgtcgactatttcggcggccatggggcattgctgctcgggcacggccacccgaaggtggtcgaggcggtgcagcggcagatcgagcgcggcactcattacggcgccagtcacgaaaccgagatcgcctgggccgaatgggtcatgaagctgatcccgtcggccgagcgggtgcgcttcacgtcctcgggcaccgaggcgacgatgatggcggtgcggctcgcccgcgccttcaccggcaaatccaaattcatccgcttcaagcaccatttccacggctggcacgaccacatgacctcgggctatgcgagccactttgacggcagcccgacccctggtgtgctgccggggatcactggcggcctgttgctggccgagcagaacgacgccgaagggctggcccgcctgctggaggccaatgacgatgtcgccgcggcgatcctcgagccgaccggcgcccacggggcgcagctgccgatcgacccaaaattcctggtcgcgctgcgcgagctgacgcggcagcacggtgtcgtgctgatcttcgacgaggtggtgaccggtttccgggtttccccaggcggggcgcaggccgaatacgggattcgcccggacttgacgaccttggccaagatccttgccggcgggttgccgggcggcgcggtcgccggccgcaaggacatcctcgacctcctcgacttccagatcaccaaggccgccgaccgcgagaagatcacccatcagggcaccttcaacgccaacccgctgtcggccgctgccggggtcgcggcgctcgaaatcgtcggcacgaccgacgcctgcgcggccgccaaccgctacgccgacacgatgcggcgccggatcaacgaggtgttcgaggaagagcacgtgccatgggcggcctacggcatgttctccaacttccatttcttcaccaaccccgaccgccggacgatcgtcccgacccgcttcgacccgctcgagcagccgccggcggcgctcaccggcaagagccaggcgggcctggtccacaaattccggctggcgatgatgacggccggggtcgatttcagcggtagccccggcggcgtcatctccgccacccacggcgacgctgagctcgaagacacgctgaaagcgctgcgcagcaccctccggatgctgcgtcaggagggcgagctttaa

SEQ ID NO: 156 - protein, 453 aa, Unknown
  Obtained from environmental sample
  SIGNAL (1)...(19)
  DOMAIN (44)...(371): Aminotransferase class-III
KNSPIIAAYRAATPGSAAAAEKASRLFPSGITHDSRYIEPYGLYITRAQGPRKWDVDGNCYVDYFGGHGALLLGHGHPKVVEAVQRQIERGTHYGASHETEIAWAEWVMKLIPSAERVRFTSSGTEATMMAVRLARAFTGKSKFIRFKHHFHGWHDHMTSGYASHFDGSPTPGVLPGITGGLLLAEQNDAEGLARLLEANDDVAAAILEPTGAHGAQLPIDPKFLVALRELTRQHGVVLIFDEVVTGFRVSPGGAQAEYGIRPDLTTLAKILAGGLPGGAVAGRKDILDLLDFQITKAADREKITHQGTFNANPLSAAAGVAALEIVGTTDACAAANRYADTMRRRINEVFEEEHVPWAAYGMFSNFHFFTNPDRRTIVPTRFDPLEQPPAALTGKSQAGLVHKFRLAMMTAGVDFSGSPGGVISATHGDAELEDTLKALRSTLRMLRQEGEL

SEQ ID NO: 157 - DNA, 879 bp, Unknown
  Obtained from environmental sample
atgagcgatcgcgttcctgagcatctaagaggctggaccgtttatctgaacggcaaatatctgtcaggcgccgaggcgtcggtgtcggtcttcgatcgcgggtttctgatgagcgatgcggtttacgagatgaccgcagtactggatggaaagctgatcgaattccccggacatatggcgcggttgagacggtcattgcgcgcgcttgagatcccattcgaactggatgaaagcgctgttttgaagatgcaccgcgaactgctacgccgaaatgcggtcaccgatggcatgctctatgtccaaatctcgcgtggtgtggccgagcgtgactttgccttcccggaaggtatcgagccgacggttttcgcctttgtcaaagacctcgacctgttgaagatgcccgcaatagaaaccgggttccgcgtcatctcgtatccagaaggacgttgggcgcggcgggatgtgaaatcgacccagatgctgtggaccagcatcggaaagaccgcggctctgcgcgcgggcgtcgatgatgtgttttttgtcgaggacggatatgtgactgaagcgtcggcctgcaatgccttcatcatcaaagacggcgttatgagatctcgcgcgctgagccaaagcatcctgcacgggatcacccgtgctgtcattgtccgcttcgctcggatcgccgggctggcgcttgacgaaaccccgttcactattgacgaggcgaaggcggcggatgaggtctttgtcaccgcctcgcctcttttcgcgattggcgttgttgaggtggatggacagatgatcggcgacggtaggccggggccgaagacaatgcagcttcggcagttgcatatcgaggagagtctgaaaaccgcgctctga

SEQ ID NO: 158 - protein, 292 aa, Unknown
  Obtained from environmental sample
  DOMAIN (17)...(284): Aminotransferase class IV
MSDRVPEHLRGWTVYLNGKYLSGAEASVSVFDRGFLMSDAVYEMTAVLDGKLIEFPGHMARLRRSLRALEIPFELDESAVLKMHRELLRRNAVTDGMLYVQISRGVAERDFAFPEGIEPTVFAFVKDLDLLKMPAIETGFRVISYPEGRWARRDVKSTQMLWTSIGKTAALRAGVDDVFFVEDGYVTEASACNAFIIKDGVMRSRALSQSILHGITRAVIVRFARIAGLALDETPFTIDEAKAADEVFVTASPLFAIGVVEVDGQMIGDGRPGPKTMQLRQLHIEESLKTAL

SEQ ID NO: 159 - DNA, 822 bp, Unknown
  Obtained from environmental sample
atgcaaacttcttatgcttttgtaaatcaacaacttgttccttttgatgccgccagcatcagcattgccgatctgggcctgctgaggggctatggggttttcgattttttcaggctggtagccggacagccattttattttgatgcacattgggcaagattgcagcattcggcttcccttttgcatttgccggtaccctttagccgcgctgaatgccttgatatggtggctgaattgtatcgcctgcattccctttctcatgccgggattcgcataaccattacgggaggcaacagccccgatggctatttaccggcgaagccaaacagcctggtcacctggcagccggtggccgatttgcctgatgtgctgccggcagaagggattgccttgtggccttacccataccaacgcccgctgcccggagtaaaatcgaccgattacctgatgggtatatggctacagcctatggctaaggaaaagggttgtcatgatgtgctttatcattgggaagaccgggtttcggaatgtccgcgcagtaatgtttttgccatcacccaaagtggcgaactcataacccccgatacaggaatgctggagggtattaccaggcaaagggtgatcaaactcgcacagggtttggtacccgtttcctgccgcacggtgcagctaacggagctctgccaggcatctgaagtttggattaccagcactaccaagggtatattgccggtaacccgcattggcgatcataccattggcgccggactcaccggtccggtggcccaaatgctctatcgaaaactgcgggaggaggaatag

SEQ ID NO: 160 - protein, 273 aa, Unknown
  Obtained from environmental sample
  DOMAIN (9)...(270): Aminotransferase class IV
MQTSYAFVNQQLVPFDAASISIADLGLLRGYGVFDFFRLVAGQPFYFDAHWARLQHSASLLHLPVPFSRAECLDMVAELYRLHSLSHAGIRITITGGNSPDGYLPAKPNSLVTWQPVADLPDVLPAEGIALWPYPYQRPLPGVKSTDYLMGIWLQPMAKEKGCHDVLYHWEDRVSECPRSNVFAITQSGELITPDTGMLEGITRQRVIKLAQGLVPVSCRTVQLTELCQASEVWITSTTKGILPVTRIGDHTIGAGLTGPVAQMLYRKLREEE

SEQ ID NO: 161 - DNA, 861 bp, Unknown
  Obtained from environmental sample
atgacgcgcaccgtatatgtgaatggccaatacctgcccgaagctgaggcaaccgtttcgatctttgatcgggggtttctgatggcggacgcagtttatgaagtgaccagcgtgctggatggcaagctgatcgattttgaaggccacgctgtgcgcctgaaccgctcgcttgaggcgctggaaatggcgtcgccttgctccaaagacgaattgctggggatccaccgcaggttggtggctgaaaacaacatcgtcgaaggtctggtgtatctgcaagtgtcgcgcggcagcgacggggatcgcgattttgtctacccctctgcggacaccaagccgactttggtgctgttcacgcagaacaaaccgggtttggcggacaaccctgcggccaagaaaggcgccaagatcatctcgatcgaggacattcgttggggccgtcgcgacatcaaaaccgtgcagctgctgtatccgtcgatgggcaaaatgatggccaagaaagccggctgtgatgatgcttggttgattgaggatggctatgtcaccgagggcacgtccaacaacgcctattttgtcaaaggcggcaagatcgtcacgcggcctttgagcactgatatcttgcatggcatcacccgcaaggctgtgctgcggattgcggctgaggcgcagatggaggtcgaagagcgactgttcaccatcgaggaggcccaagctgcggatgaggcgtttaccacctcggccagcgcgtttgtgatgccggttgtggaaattgacggtgtggcgcttggtgacggaacacccgggccaattgcgcgccggttgcgtgagatttatctggaagagagcctgaaagcggcgatctag

SEQ ID NO: 162 - protein, 286 aa, Unknown
  Obtained from environmental sample
  DOMAIN (8)...(278): Aminotransferase class IV
  SITE (54)...(57): N-glycosylation site. Prosite id = PS00001
MTRTVYVNGQYLPEAEATVSIFDRGFLMADAVYEVTSVLDGKLIDFEGHAVRLNRSLEALEMASPCSKDELLGIHRRLVAENNIVEGLVYLQVSRGSDGDRDFVYPSADTKPTLVLFTQNKPGLADNPAAKKGAKIISIEDIRWGRRDIKTVQLLYPSMGKMMAKKAGCDDAWLIEDGYVTEGTSNNAYFVKGGKIVTRPLSTDILHGITRKAVLRIAAEAQMEVEERLFTIEEAQAADEAFTTSASAFVMPVVEIDGVALGDGTPGPIARRLREIYLEESLKAAI

SEQ ID NO: 163 - DNA, 1377 bp, Unknown
  Obtained from environmental sample
atgagcgtgcactcggtcactgagctccatgcagcctatgccgcgaaatttccccgatcggcggcctcggcccgcgccgcgaacgaggccatcgccggtggcgtggcgcatgatgggcgtgctgcctcgccgttcccgctctttatcgacagcgcccagggcgcgcgcaagcgcagcgtcgatgggcacgacctgatcgatttctggatgggccatggcgcgttgatgctgggccaccgccatcccgcgatcgaggcggccgtggcccagcagcttgcccggggaacgcactttggcgccagccacgaggccgaggtgcagtgggcgcagaagatcatcgaactggtcccttcggccgagctggtgcgcttcgtggcgtcgggaacggaagcgacgcacatggcgctgcgcctggcgcgggcagccacgggccgctcacgcatctgtcgcttcgaggggcatttccacggctggcacgactgggtcgccctggggaaccgtgcgcccttcgaccaaccaagctccggggggattgctccggcggtgcgcgacgagatcacggttctgcccaacaacgatgccaacgcgttgcgcgcggcgctggcggctggtgatgtggccgccgtcatcctcgaacctgggggcggcacgcagggacgggttcctctctgttcggaatttctctgtgaagtacgagacctgacgtcgcggcaggggacggttctgatcttcgacgaggtggtgacggggtttcgcatcgcgccgggtggtgtgcaggagcggagtggcgtcgtgcctgacctgacgaccctggccaagatcgtggctggcgggctgccgggtggggccgtttgcggcaagcgggaggtgatggatgtcctctcctttgcgccgcctgctggcgtgacgcgcgtggcgcaccccggaacgttcaatgccaatccgctcagtgccgccgctggcatcgcgatgctggaggaggtcgccgatggtggcccgctggacgatgccgccgcgagtgcggccatcctgcggcgcggcatcaacgatctcctggccgcgcgcggcatcgctggctttgcctatggcgatcgttccatcgtgcacatcctgctcgggccggccggacggcgagcgcgggcggctgacggtaatcttgacaccatccccgccgccgagttgctggcggccgatccggtcgtggcgaaagccttgcgcaccgcctgcctctttcacgggctggatctgatggggccgacgatgatggtcgcgagcgtccacgatgccgccgcgatcgacgaggcgctgacgaggttcgagcgggtgttcgccacgctgatggcgcttgacgagtgccaaccgattttggaggcctga

SEQ ID NO: 164 - protein, 458 aa, Unknown
  Obtained from environmental sample
  DOMAIN (48)...(364): Aminotransferase class-III
MSVHSVTELHAAYAAKFPRSAASARAANEAIAGGVAHDGRAASPFPLFIDSAQGARKRSVDGHDLIDFWMGHGALMLGHRHPAIEAAVAQQLARGTHFGASHEAEVQWAQKIIELVPSAELVRFVASGTEATHMALRLARAATGRSRICRFEGHFHGWHDWVALGNRAPFDQPSSGGIAPAVRDEITVLPNNDANALRAALAAGDVAAVILEPGGGTQGRVPLCSEFLCEVRDLTSRQGTVLIFDEVVTGFRIAPGGVQERSGVVPDLTTLAKIVAGGLPGGAVCGKREVMDVLSFAPPAGVTRVAHPGTFNANPLSAAAGIAMLEEVADGGPLDDAAASAAILRRGINDLLAARGIAGFAYGDRSIVHILLGPAGRRARAADGNLDTIPAAELLAADPVVAKALRTACLFHGLDLMGPTMMVASVHDAAAIDEALTRFERVFATLMALDECQPILEA

SEQ ID NO: 165 - DNA, 1314 bp, Unknown
  Obtained from environmental sample
atggacacgtaccgggcgatgcaccccaagtccggcgcgctgtacgagcgcgcgcgcaacgtcatctccggtggcatcacccacgacggccgtcacctcaacccgtacccggtgtacatcgaccgcgcgctgggctcgcgcaagtgggacgtggatgggaacgagtacgtcgactactggatggggcacggcgcgctgatcctgggccactgccaccccgctgtcgtcgcggcgatccagaagcaggccggccgcggaacgcatctcggcgcctcgcacgagctcgaggtgcgctgggccgagctggtctcgaagctcatcccgtcggccgagatggtgcgcttcacgatgtcgggcaccgaggccacgcacctcgcgatgcgcatcgcccgtgcctacacgaatcgcccgaagatcctgaagttccaggggcacttccacggctggcacgacggcgtcgccctcgccgtcgatccgccctacgacgtgccgtggtccgccggcgtgccggcctccacgctcgaccagatcctgctgtgcccgcccaatgacatcaaggcggtggagacggtgctccagcgtggcgacgtcgccgcggtgatcctcgagcccgccggaggcggctccagcaccatccccaccatccccggctatctccaagagctgcggagcctcaccgagcgcctgggcgtggtgttgatcttcgacgaggtgatctcgggcttccgctattcgccgggcggcgcgcaggcgtacttcggcgtgacgccggacatgaccaccctcgccaagatcgttgcgggtggcctccccggcggcgcggtggtgggcaagaagccgctcatgggcatgatggcccgccgcggcgacccggtgtgggaccgcagccagcgcgtggcccagaatggcacgttcaactcgaacccgctctgcgcggccgccgccatcgccacgctggagctggtctccgacggcagcctccacgcgcgcgccaacaaggtgggcgacgagctccgcacctcgctctccgacgtgatgaagcgggtgggcgtgcccggcaccaccttcggcgacgtgtccatcttccacgtgtcgttcgagggcaagcccggtctcgcgggcttcgatcgcccgcgccgcggtgatctctatcagctcctgcgctgcgcgctcctgaaccacgggctcgactgctcgagctatcacgggtggatctccgccgtgcactcgaacgaggacatcgaccgcaccgtgcagggctacgaggccgccttcaaggacatggcggccgacggcgccttcaagggcatgtaa

SEQ ID NO: 166 - protein, 437 aa, Unknown
  Obtained from environmental sample
  DOMAIN (39)...(363): Aminotransferase class-III
  SITE (157)...(163): N-6 Adenine-specific DNA methylases signature. Prosite id = PS00092
  SITE (306)...(309): N-glycosylation site. Prosite id = PS00001
MDTYRAMHPKSGALYERARNVISGGITHDGRHLNPYPVYIDRALGSRKWDVDGNEYVDYWMGHGALILGHCHPAVVAAIQKQAGRGTHLGASHELEVRWAELVSKLIPSAEMVRFTMSGTEATHLAMRIARAYTNRPKILKFQGHFHGWHDGVALAVDPPYDVPWSAGVPASTLDQILLCPPNDIKAVETVLQRGDVAAVILEPAGGGSSTIPTIPGYLQELRSLTERLGVVLIFDEVISGFRYSPGGAQAYFGVTPDMTTLAKIVAGGLPGGAVVGKKPLMGMMARRGDPVWDRSQRVAQNGTFNSNPLCAAAAIATLELVSDGSLHARANKVGDELRTSLSDVMKRVGVPGTTFGDVSIFHVSFEGKPGLAGFDRPRRGDLYQLLRCALLNHGLDCSSYHGWISAVHSNEDIDRTVQGYEAAFKDMAADGAFKGM

SEQ ID NO: 167 - DNA, 861 bp, Unknown
  Obtained from environmental sample
atggacgcgctgggctattacaacgggaaatggggacctctggacgagatgaccgtgccgatgaacgacaggggttgttactttggggacggcgtgtacgacgctgcctgtgccgccaacggaacgatctttgccccggatgagcatattgatcggtttttcagcggcgcaaagcttctggaaataaaaatcagcttaacaaaagaggaattgaaaagaaccctcaatgaaatgctctgtaaagtagacaagggggagtaccttgtttattggcaggcgactcgcggaacaggccgtcgaagccatgcatttccggcgggcccctcaaatctctggattatgataaagccccaccccatcgacgatctatataaaaaaataaagctcattaccatggaagacacccgctttctccactgcaacatcaagacccttaaccttattcccaatgtcatcgcttcccagcgggcgctggaagcgggctgctacgaaacggtatttcaccggggcgaaacggtaaccgagtgcgcccacgacaatgtccacatcatcaaaagcggcaggtttatcacccatcctgcaaacaacctgatcctcaggggcatagcccgcagtcatttattgcaagcctgcgacaggctggacattccggttgaagaacgggaatttagcctgtcggagttgtttgacgcggacgaggtgcttgtgtccagttgcggcagtttcggtcttagcgccgatgcaattgacggaaaagacgtgggaggaaaagcgccggaactgcttaaaaaaattcaggacgaggtgctgagggaatttatcgcagcgacaggctacgcgcccgcctggagcagggtgtag

SEQ ID NO: 168 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFSGAKLLEIKISLTKEELKRTLNEMLCKVDKGEYLVYWQATRGTGRRSHAFPAGPSNLWIMIKPHPIDDLYKKIKLITMEDTRFLHCNIKTLNLIPNVIASQRALEAGCYETVFHRGETVTECAHDNVHIIKSGRFITHPANNLILRGIARSHLLQACDRLDIPVEEREFSLSELFDADEVLVSSCGSFGLSADAIDGKDVGGKAPELLKKIQDEVLREFIAATGYAPAWSRV

SEQ ID NO: 169 - DNA, 882 bp, Rhodococcus erythropolis DSMZ 44522
atggctgaccatccgggcgtcgtcgtcaccctcgacgggcagctgcacgacccgcaggcgccgttgctgtacgccgacgacctcgcggcagtgcggggcgacggcatcttcgagaccctgctggtgcgtgacggcggaccgtgcctgctgggcgcgcacctggaccggctggcgcactccgcccgcctcgtcgacctgcccgagcccgacgccgggcagtggcgggcggcggtggccctcgcggtggagcactggctggccgggggatcggacgaaggcgtgctgcggctggtgtacagccggggacgcgaacacggttcggcgcccaccgcgtacgcggcggtcgggtcgctgccgtcacgggtcgcggccgtgcggcgcgacggggtggcggcgatgaccctgcaacgcagcctgcccgcggacggcatcgacgcgatgccgtggctgctggccggcgcgaagacgctgtcgtatgcggtgaacatggccgcgctgcggcatgcggaacggcacggcgccggcgacgtcatcttcgtcagtaccgacgggcacatcctggagggtcctcgatcgaccgtcgtcatcgcgaccacctcacctgacggcgcaacgtgcctgctgacgccgccgccgtggtatccgatcctgcgcggcaccacccagcaggcgctgttcgaggttgcccgcaacaagggctacgactgcgactaccaggccctgcggcccgccgacctggttgccgcgcaaggagtctggctggtctccagcatcacgctggccgcccgggtgcacactctcgacggtgcgccgttgcctgcggcaccgctggacggtgagatcgccgcgctgatcgacgcggccgtcctcagcgatcgctga

SEQ ID NO: 170 - protein, 293 aa, Rhodococcus erythropolis DSMZ 44522
  DOMAIN (12)...(290): Aminotransferase class IV
MADHPGVVVTLDGQLHDPQAPLLYADDLAAVRGDGIFETLLVRDGGPCLLGAHLDRLAHSARLVDLPEPDAGQWRAAVALAVEHWLAGGSDEGVLRLVYSRGREHGSAPTAYAAVGSLPSRVAAVRRDGVAAMTLQRSLPADGIDAMPWLLAGAKTLSYAVNMAALRHAERHGAGDVIFVSTDGHILEGPRSTVVIATTSPDGATCLLTPPPWYPILRGTTQQALFEVARNKGYDCDYQALRPADLVAAQGVWLVSSITLAARVHTLDGAPLPAAPLDGEIAALIDAAVLSDR

SEQ ID NO: 171 - DNA, 864 bp, Unknown
  Obtained from environmental sample
atggacgcgctgggttattacaacggaaaatgggggcctctggacgagatgaccgtaccgatgaacgacaggggctgttactttggggacggcgtgtacgacgctgcctgcgccgccaacggaacgatctttgccctggatgaacatattgaccggtttttcaacggcgcaaagctcctggaaataaaaatcggcttatcaaaagaggaactgaaaagaactcttaatgaaatgctctgtaaagtggacaagggggagtacatggtttattggcaggcgactcgcggaacaggccgtcgaagccatgtatttccggcaggcccctcaaatctctggattatgataaagccccatcccatcgacgatctttataaaaaaataaagctcattaccatggaagacacccgctttctccactgcaacatcaagacccttaaccttattcccaatgtcattgcctcccagcgggcgctggaagcgggctgctacgaaacggtatttcaccggggcgaaacagtaaccgagtgtgcccacgacaatgtccacatcatcaaaaacggcaggtttatcacccatccggtggacaacctaatcctccggggcatagcccgcagtcatttattacaagcctgcgacaggctgaacattccggttgacgaacgggaatttagcctgtcggagttgtttgacgcggacgaggtgcttgtgtccagttgcggatctttcggccttagcgccgatgcaattgacggaaaagacgtgggaggaaaagcgccggaactgcttaaaaaaattcaggacgaggtgcttagggaatttgtcgaagcgacaggctacacgcctgcgtggaacaagaaagtatag

SEQ ID NO: 172 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFALDEHIDRFFNGAKLLEIKIGLSKEELKRTLNEMLCKVDKGEYMVYWQATRGTGRRSHVFPAGPSNLWIMIKPHPIDDLYKKIKLITMEDTRFLHCNIKTLNLIPNVIASQRALEAGCYETVFHRGETVTECAHDNVHIIKNGRFITHPVDNLILRGIARSHLLQACDRLNIPVDEREFSLSELFDADEVLVSSCGSFGLSADAIDGKDVGGKAPELLKKIQDEVLREFVEATGYTPAWNKKV

SEQ ID NO: 173 - DNA, 861 bp, Unknown
  Obtained from environmental sample
ttggacgcgctgggatactacaacggcaaatggggccccctggacgaaatcaccgtgccaatgaacgacagaggctgctacttcggagacggcgtgtacgatgccgcctgcgcggctaacggagtgacctttgccctggatgagcacattgatcgttttttcaacagcgcagagctcctggaaataaaaatcaatttaacaaaagaagaactgaaaaaaaccctcaatgaaatgtgctccaaagtggataagggagtgtacatggtttattggcaggtaactcgcggaacaggccggcgtaaccatgtttttccggaaggcccctcaaatctctggattatgataaagccttatcccttatgtgatctttataaaaaaataaagctcatcacaatggacgatacccgctttctccactgcaacattaagaccattaaccttattccaaatgtcattgcatcccagcgggcgctggaagcgggctgttacgaaacggtatttcaccggggcgaaacagtaaccgagtgcgcccacagcaatgtccacatcctcaaaaacggcaggtttatcacccatcaggcggacaatctgatcctcccgggcattgcccgcagccatatattgcaggcctgcggcaggctgaaaatcccggttgacgagcgggagtttaccctttcggaattgtttgacgcggacgaggcgattgtgtccagcagcggtgatttctgcgttagcgccgaaataatcgatggaaaaagcgtgggagggaaagcgccggaactgcttaaaaaaattcaggacgaagtgttgagggaatttaccgaagcaactggctatacgcctgagtggagtaaggtatag

SEQ ID NO: 174 - protein, 286 aa, Unknown
  Obtained from environmental sample
  DOMAIN (8)...(270): Aminotransferase class IV
MDALGYYNGKWGPLDEITVPMNDRGCYFGDGVYDAACAANGVTFALDEHIDRFFNSAELLEIKINLTKEELKKTLNEMCSKVDKGVYMVYWQVTRGTGRRNHVFPEGPSNLWIMIKPYPLCDLYKKIKLITMDDTRFLHCNIKTINLIPNVIASQRALEAGCYETVFHRGETVTECAHSNVHILKNGRFITHQADNLILPGIARSHILQACGRLKIPVDEREFTLSELFDADEAIVSSSGDFCVSAEIIDGKSVGGKAPELLKKIQDEVLREFTEATGYTPEWSKV

SEQ ID NO: 175 - DNA, 861 bp, Unknown
  Obtained from environmental sample
atggacgcgcttggctattacaacggaaaatgggggcctctggacgagatgaccgtgccgatgaacgacaggggatgctactttggagacggcgtttacgacgctacctgcgccgctaacggagtgatctttgccctggatgagcatattgaccggtttttcaacagcgcaaagcttctggaaatagaaatcagtttaacaaaaggggaactaaaaaaaacccttaatgaaatgcactccaaagtggataagggggagtacctggtttattggcagacgacccgcggaacaggccggcgaaaccatgtttttccggcaggcccctcaaatctctggattatgataaagccctatcccatcgacgatctttatcgaaaaataaagctcatcactatggaagatacccgctttttccactgcaacatcaagacacttaaccttattcccaatgtcattgcctcccagcgtgctctggaagtcggctgccacgaggcggtctttcaccgcggcgaaacagtaaccgagtgcgcccacagcaatgtccacatcatcaggaacggcaggtttatcacccaccaggcggacaacctgatcctccggggtatagcccgcagccatttattgcaagcatgcgtcaggctgaacattccggttgacgaacgggagtttaccctttcggaattgtttgacgcggacgaggtaattgtatccagcagcggcactttaggccttagcgccgatacaatcgatggaaaagccgtgggagggaaagcgccggagctgcttaaaaaaatccaggacgaagtgctgagggaatttaccgaagttacaggctataagcctgcgtggagcagggtatag

SEQ ID NO: 176 - protein, 286 aa, Unknown
  Obtained from environmental sample
  DOMAIN (8)...(270): Aminotransferase class IV
MDALGYYNGKWGPLDEMTVPMNDRGCYFGDGVYDATCAANGVIFALDEHIDRFFNSAKLLEIEISLTKGELKKTLNEMHSKVDKGEYLVYWQTTRGTGRRNHVFPAGPSNLWIMIKPYPIDDLYRKIKLITMEDTRFFHCNIKTLNLIPNVIASQRALEVGCHEAVFHRGETVTECAHSNVHIIRNGRFITHQADNLILRGIARSHLLQACVRLNIPVDEREFTLSELFDADEVIVSSSGTLGLSADTIDGKAVGGKAPELLKKIQDEVLREFTEVTGYKPAWSRV

SEQ ID NO: 177 - DNA, 1374 bp, Unknown
  Obtained from environmental sample
atgacgaccacgctgcggatcaccgaccagtacaccgccgaccacccgaaatcgcgggcgctgcatgagcgggcgcgcaccgtgatccccggcggcatcgcccatgatgtccgcaacatgcggccctttcccctgacgatggagcgcggcgagggcgcgtacaagtgggacgtggacggccatcagtacaccgattacgtggtcgggcacggctcgctgatcctggggcacagccacccgcaggtcgtggaggccgtgcgcacgcaaatgacgcagggcacccacctgggcgcgggcacgccgcacgagatcgcctgggccgaactcgtgcaacggctgatccccagcgccgacctgacgaagttcacctcgagtggcaccgaagcaacaatgatggcgatgcgcctcgcacgggcgtacacgggcaaagacaaaatcctcaagttcgccggccacttccacggctggcacgattacgccgtggcggggcagacgccgccgtgggacgtgcccgcctccgccggtgtgccgggggaaacgctctccacgatggtgatcgcccccgtgaacgacctcgacttcgtggatgcccgcctcgcgcaaggcgacatcgcaggcgtgattctggaggcgagcggcgcgtcgtgggcggcgatcccgcaccctcccggctacctccagcggctgcgtgagatcacggcccggcatggcgtcgtgatgattatggatgaagtgatcaccggctttcgctactcccccggtggcgtccaggccgtggagggcgtgacgcccgacctgaccacgctggcgaagattctcgcgggcggcctgcccggtggcgcggtggcgggcaaggcggagatcatgaacctgctcaccttccgcgacgacccgcagtggaaccgctatcacaaggtcgggcaccccggtacgtacaacgccaacccgctctccgccgtggcgggcgtgaccgcgctgacgatcctttccgaccccacacatcagcagtacgccgatgccctcgcggtgcggctgcgggcgggcttcaaccgcgtgctgctgcatgaagaagtccctggcttttgccacggcgaatcgagcatgtttcacctcgtgctcggcacgtcgtatcccggtggcacgccggacggcgatttgcagcgcccagagagcgtcgcgccggaaatcctcaagcgcggtatcgcgcccaagctcgacgcgcccctgtactgcggcatggttgccgaaggcgtagacctctttcatggcggtggcatgctttccaccgcgcacaccgaggcagatgtagaccgcaccatcgaagcattcgacaccgccgtgcgccgcatgacgaacgaaggagccttcgagtag

SEQ ID NO: 178 - protein, 457 aa, Unknown
  Obtained from environmental sample
  DOMAIN (46)...(364): Aminotransferase class-III
MTTTLRITDQYTADHPKSRALHERARTVIPGGIAHDVRNMRPFPLTMERGEGAYKWDVDGHQYTDYVVGHGSLILGHSHPQVVEAVRTQMTQGTHLGAGTPHEIAWAELVQRLIPSADLTKFTSSGTEATMMAMRLARAYTGKDKILKFAGHFHGWHDYAVAGQTPPWDVPASAGVPGETLSTMVIAPVNDLDFVDARLAQGDIAGVILEASGASWAAIPHPPGYLQRLREITARHGVVMIMDEVITGFRYSPGGVQAVEGVTPDLTTLAKILAGGLPGGAVAGKAEIMNLLTFRDDPQWNRYHKVGHPGTYNANPLSAVAGVTALTILSDPTHQQYADALAVRLRAGFNRVLLHEEVPGFCHGESSMFHLVLGTSYPGGTPDGDLQRPESVAPEILKRGIAPKLDAPLYCGMVAEGVDLFHGGGMLSTAHTEADVDRTIEAFDTAVRRMTNEGAFE

SEQ ID NO: 179 - DNA, 855 bp, Unknown
  Obtained from environmental sample
atgaacaaaattaatgcttttgtcaacggcgactacctgcctgctgaagaggcatgtcttaacattgaagacagagcttccctttttggcgacggctgctatgaattttttaaagtacaccgcggcaaggtttttgaaactgaggcacatttaaagaggctgcactacagcgccggggaacttgaaataagaattccttacagcgacaaagaaattactgaaatcttggataagctaattgagcttaattccattgaatacggcggaatttacctgcagctgacaaggggtgccgccccgcgcattcacaattatcccgacaggtgttcgccaaacttttttattgtggcccgggaaatgccgccgatggaaaagaagctcttggaagaaggcatcaaagctgtgctgctgcctgatgagcgctggaagcgctgtgatattaagtcgcttaacctgctggccaatattatggccaaggaaaaagcaaaaaagatgggtgctttggatgccattttgtacagtgaactgggtgtgaccgagtccaccagcagcagtgtgcttgctgtgttaaacggtgaattggtgaccacgccggagggtaactggattttgcctggtctcaccaaaagggtggccatgcggattgccaaagaaaacaatattaatgtacaggaaaggtttatgagcaccgatgagcttctggccgctgaggaaataatgctggccggaacaaggattgaccttttgcctgtgacagagcttgacggcaagcctgtgggaaccggtaaggtgggtcctgttaccaaaatactgctaagcggttttgcacgtgccctggatgagaatgtcaaatag

SEQ ID NO: 180 - protein, 284 aa, Unknown
  Obtained from environmental sample
  DOMAIN (9)...(276): Aminotransferase class IV
MNKINAFVNGDYLPAEEACLNIEDRASLFGDGCYEFFKVHRGKVFETEAHLKRLHYSAGELEIRIPYSDKEITEILDKLIELNSIEYGGIYLQLTRGAAPRIHNYPDRCSPNFFIVAREMPPMEKKLLEEGIKAVLLPDERWKRCDIKSLNLLANIMAKEKAKKMGALDAILYSELGVTESTSSSVLAVLNGELVTTPEGNWILPGLTKRVAMRIAKENNINVQERFMSTDELLAAEEIMLAGTRIDLLPVTELDGKPVGTGKVGPVTKILLSGFARALDENVK

SEQ ID NO: 181 - DNA, 876 bp, Unknown
  Obtained from environmental sample
atgacggagatggtatctgtaaatggccggatcacggatttgcatacggcacatataccgattttggatcgagggtttttgtacggggattccatatttgagagttttcgcagctatgacggaggttttttcgggttatcagagcatttggcccgttttcgccgctccgccgacatgctgcgcatgcccatgccgctggatgaggtagcgtggcgagagcagatggctgctaccatgcaggcagccggatcaggcgattatgtggttcgactgattcagacgcggggatcggctccttttcatcagggattgcgcaaggcagagcatcctttgtctattgtcatggtgcgtgagctgccaccacctgatccatccctggttcagcatggctgtcgtttgtatctttcaagcgtacgccgtaatgattcaagggcgctgaacccctcggcaaaaaccggcaattatctgaataatgtgctggccatgatggaagcagaagcccatggttgccatgaagccctgatgttgaatgcacagggcgaagtgaccgaaggtacccgatccaatctgtttatcgtgcgagaagggattctttgtactcctcctttatcagccgggattctggaaggcattacgcgcgagatggtcatgcgggtagcatgcgaggaaggtatttcatgtcaggaaacgccacttatgcccgatgatatgctgcaggctcaggaggtatttattaccagttcgatcagtgaagtgcttccggcggttatgctgaatgagtcggtgattggagagggctttccgggccctgtcacgaagcaactggcagaggcctatggccgctatcgtgacagaaacctggagcgtctgttctag

SEQ ID NO: 182 - protein, 291 aa, Unknown
  Obtained from environmental sample
  DOMAIN (8)...(280): Aminotransferase class IV
  SITE (143)...(146): N-glycosylation site. Prosite id = PS00001
MTEMVSVNGRITDLHTAHIPILDRGFLYGDSIFESFRSYDGGFFGLSEHLARFRRSADMLRMPMPLDEVAWREQMAATMQAAGSGDYVVRLIQTRGSAPFHQGLRKAEHPLSIVMVRELPPPDPSLVQHGCRLYLSSVRRNDSRALNPSAKTGNYLNNVLAMMEAEAHGCHEALMLNAQGEVTEGTRSNLFIVREGILCTPPLSAGILEGITREMVMRVACEEGISCQETPLMPDDMLQAQEVFITSSISEVLPAVMLNESVIGEGFPGPVTKQLAEAYGRYRDRNLERLF

SEQ ID NO: 183 - DNA, 825 bp, Unknown
  Obtained from environmental sample
atgatcacaacttatttcaacggacgttacattgacgccggtgaggctgtcatccctatcgaggagcgtggccacaattttggtgacgggatttacgatgtcatccgcgtgtacaacggggagccgtttttcctcgaggaacaccttgaccgcatttttatgagtgcccgagagattcgactcgatatcgggtacgaccgtgaaggcttcaaacagttgctccacgacgttgttgcgacaaacggcggcacaaacgtcgacatctatctacaggtgacacgtggcatcgctccacgggcgcatgcttttccgcaagcacccgcatcggtgagcatcattgtgcggcccagccccgcatacaccggtacatcagatgcgatgctgcacccggatgagcggtgggcgaactgctacatcaagtcgctcaacctcttgcccaacattctcgccttccagacagcgcaagataacggctgctgcgaggcaattctcgtcaaggacggacacatcacggaaggctcacgcacttcggtgatgatggtcaaacatggcgaggtgtgggcgccggtgttgacgaagcaaattctgtcgagcatcacccgcatggctgtcaagcaagccgccgcccgagccgggatcccctttatcgagaaggatttcacgcccgaggagttgatcgctgccgatgaagtgttcatcgccggaacgggcagcgaaatccatcccattcaccgcatcgacggcgctgacatcggtaacggcacaacaggttccatcaccactaccctaatcgacgagtttatgagactcacccgcggcgagtag

SEQ ID NO: 184 - protein, 274 aa, Unknown
  Obtained from environmental sample
  DOMAIN (7)...(268): Aminotransferase class IV
  SITE (256)...(259): N-glycosylation site. Prosite id = PS00001
MITTYFNGRYIDAGEAVIPIEERGHNFGDGIYDVIRVYNGEPFFLEEHLDRIFMSAREIRLDIGYDREGFKQLLHDVVATNGGTNVDIYLQVTRGIAPRAHAFPQAPASVSIIVRPSPAYTGTSDAMLHPDERWANCYIKSLNLLPNILAFQTAQDNGCCEAILVKDGHITEGSRTSVMMVKHGEVWAPVLTKQILSSITRMAVKQAAARAGIPFIEKDFTPEELIAADEVFIAGTGSEIHPIHRIDGADIGNGTTGSITTTLIDEFMRLTRGE

SEQ ID NO: 185 - DNA, 825 bp, Unknown; identical to SEQ ID NO: 183
  Obtained from environmental sample

SEQ ID NO: 186 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 187 - DNA, 861 bp, Unknown
  Obtained from environmental sample
atggacgcgctgggctattacaacggaaaatgggggcctctggacgagatgaccgtaccgatgaacgacaggggctgttactttggagacggcgtgtacgacgccgcatgcgccgccaacggaacgatctttgccccggatgagcatatcgaccggtttttcaacggcgcaaagctcctggaaataaaaatcagcttaacaaaagaggaactgaaaaaaacccttaatgaaatgctctgtaaagtggacaacggggagtgcctggtttattggcaggcgacccgcggaacgggccgtcgaagccatgtatttccggcaggcccctcaaatctctggattatgataaagcctcatcccatcgacgatctttataaaaaaataaagctcattaccatggaagacacccgctttctccactgcaacatcaagacccttaatcttattcccaatgtcatcgcctcccagcgggcgctggaagctggttgctacggaacggtatttcaccggggcgaaactgttaccgagtgcgcccacgacaatgtccacatcatcaaaaacggcaggtttatcacccatccggcggacaacctgatcctccggggcatagcccgcagtcatttattgcaagcctgcgacaggctggacattccggttgaagaacgggagtttactctttcggaactgtttgacgcggacgaggtacttgtatccagttgcggcactttcggtcttagcgccgatgcaattgacggaaaaggcgtggggggaaaagcgccggaactgcttaaaaaaattcaggacgaggtgctgagggaatttatcgaagcgacaggctacgcgcctacatggagcagggcatag

SEQ ID NO: 188 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFNGAKLLEIKISLTKEELKKTLNEMLCKVDNGECLVYWQATRGTGRRSHVFPAGPSNLWIMIKPHPIDDLYKKIKLITMEDTRFLHCNIKTLNLIPNVIASQRALEAGCYGTVFHRGETVTECAHDNVHIIKNGRFITHPADNLILRGIARSHLLQACDRLDIPVEEREFTLSELFDADEVLVSSCGTFGLSADAIDGKGVGGKAPELLKKIQDEVLREFIEATGYAPTWSRA

SEQ ID NO: 189 - DNA, 864 bp, Unknown
  Obtained from environmental sample
atggacgcgctgggctattacaacggaaaatgggggcatctggacgagatgaccgtgccgatgaacgacaggggttgctactttggagacggtgtgtacgacgctgtctgcgccgccaacggaacgatctttgccctggatgagcatatcgatcggtttttcaacggcgcgaagctcctggaaataaaaattagcttaacaaaagaagaactgaaaaaaacccttaatgaaatgctctcaaaagtggacaagggagagtgcctggtttattggcaggcgactcgcgggacaagccgtcgaaaccatgcatttcctacaggcccctcaaatctctggattatgataaagccccatcccatcgatgatctttacaaaaaaataaagctcattaccatggaagacacccgcttcctccactgcaacatcaaaacccttaaccttattcccaatgtcatcgcctcccagcgggcgctggaagcgggctgctacgaaacggtatttcaccggggcgaaacagtaaccgagtgcgcccacgacaatgtccacatcatcaaaagcggcaggtttatcacccatccggcgaacaacctgatccttcggggcatagcccgcggtcatttactggaagcctgcctcaggctggacattccggtcgacgaaagggagtttaccctttcggaactttttgacgcggacgagatacttgtatccagttgcggcactttcggtcttagcgccgacgcaatagacggaaaagacgtgggggggaaagcgccggaactgcttaaaaaaattcaggacgaggtgctgagggaatttatcgaagcgacaggctacgcgcctgcctggagcaaaaaggtatag

SEQ ID NO: 190 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGHLDEMTVPMNDRGCYFGDGVYDAVCAANGTIFALDEHIDRFFNGAKLLEIKISLTKEELKKTLNEMLSKVDKGECLVYWQATRGTSRRNHAFPTGPSNLWIMIKPHPIDDLYKKIKLITMEDTRFLHCNIKTLNLIPNVIASQRALEAGCYETVFHRGETVTECAHDNVHIIKSGRFITHPANNLILRGIARGHLLEACLRLDIPVDEREFTLSELFDADEILVSSCGTFGLSADAIDGKDVGGKAPELLKKIQDEVLREFIEATGYAPAWSKKV

SEQ ID NO: 191 - DNA, 861 bp, Unknown; identical to SEQ ID NO: 187
  Obtained from environmental sample

SEQ ID NO: 192 - protein, 286 aa, Unknown; identical to SEQ ID NO: 188
  Obtained from environmental sample
  DOMAIN (8)...(270): Aminotransferase class IV
  SITE (40)...(43): N-glycosylation site. Prosite id = PS00001

SEQ ID NO: 193 - DNA, 861 bp, Unknown; identical to SEQ ID NO: 187
  Obtained from environmental sample

SEQ ID NO: 194 - protein, 286 aa, Unknown; identical to SEQ ID NO: 188
  Obtained from environmental sample
  DOMAIN (8)...(270): Aminotransferase class IV
  SITE (40)...(43): N-glycosylation site. Prosite id = PS00001

SEQ ID NO: 195 - DNA, 858 bp, Unknown
  Obtained from environmental sample
ttgaaaaatttggcctggttaaacggcagtatttgtgatatttctgaagcaaaggttccgcttgaagaccggggcttcttttttggcgacggggtatatgaggtaattaaaatatataatggtaagccattttatttggttccacatctaaaaaggcttcaaaacagcaccagtgctatcgagattgaacttccctctacgatcgaggaaattaaaacaagtattgctgatttaattaaaaagagcgaaatcctgaatgggtatctctacatgcagataacaaggggttgtgcagaaagagaccatttaccccctgtagatatcaagccttcgatgatcatgtatgtcagggagtttgatgcacctgcttcagtactggatcattttaaaccggccagttgtattactctgccggatgaaagatggcttcactgtaatattaaatcggttaatttgctgcccaatattctggccaggaaaaaagctgctaaagcaggtgctgtagaagcaatactataccgtccgggaggggtcgttacagaagggaccaggaccaatatatttgccgtgatcgatggcaaagtccgtacccatccggaatcaaatttaattttgtcgggtattaccaggagtatcgttattgacattatgagcaagcagcaggtcccctttcttgaagaagcaattaatgtagaggagctaaaacaggcatctgaagtgtggacgacctcttcgggaatagaaattcacccgatcagtattatagatgggcgaacggtgagtgaggatataccaggccctgtctgccggcatttgattgcagaatttcggaaaatcattgaagcagagtgttattaa

SEQ ID NO: 196 - protein, 285 aa, Unknown
  Obtained from environmental sample
  DOMAIN (8)...(277): Aminotransferase class IV
  SITE (8)...(11): N-glycosylation site. Prosite id = PS00001
  SITE (55)...(58): N-glycosylation site. Prosite id = PS00001
MKNLAWLNGSICDISEAKVPLEDRGFFFGDGVYEVIKIYNGKPFYLVPHLKRLQNSTSAIEIELPSTIEEIKTSIADLIKKSEILNGYLYMQITRGCAERDHLPPVDIKPSMIMYVREFDAPASVLDHFKPASCITLPDERWLHCNIKSVNLLPNILARKKAAKAGAVEAILYRPGGVVTEGTRTNIFAVIDGKVRTHPESNLILSGITRSIVIDIMSKQQVPFLEEAINVEELKQASEVWTTSSGIEIHPISIIDGRTVSEDIPGPVCRHLIAEFRKIIEAECY

SEQ ID NO: 197 - DNA, 858 bp, Unknown
  Obtained from environmental sample
gtgggaaatttggcctgggtaaatggtaaaatttctgaattagatgatgcaaaagttggagttcaggacaggggttttttatttggtgacggagtttatgatgttataaaaatatataacggtaatccattcaggctattatctcaccttgaaagactgcagcgaagctgtaatgctattagcatagaactgcctcattccataggagatgtagaggtagttgtagggaatttgattaaggagagcgcttgcaaggatggttttatttatatgcaggtgacaaggggttgtgcgccccgtgatcacttctttcctatcggggtggagcctacttttctgatctatatccttgatctcggtttcccctcaacaaaaagcagcctgaaagtaacagcatgcatcaccctcccggatgagcggtggatgaactgccatattaaatcgaccaacctgctccctaatgtactatccctgcaaaaagcaaaagaagcaggcgccggggaggcaatcttataccggccggatggcacggtaacagagggcacacggactaacatatttgccgtaattgacggcattgtccgcactcacccggaatccccgttaattttaccagggattacaaggaatattgccctggatatttttaaagaagctaatgtcgcggttttagaagaagctttctctactgatgatttaagcagggcttcagaagtatggacaacttccaccggtctagaaatatccccggttaataaaatcgatggccgcgtagttgacgcggccgctccaggttcggtttgcagcttactgctggatcatttttggcaaaaagtagaggaagaatgcggtgtttaa

SEQ ID NO: 198 - protein, 285 aa, Unknown
  Obtained from environmental sample
  DOMAIN (8)...(276): Aminotransferase class IV
MGNLAWVNGKISELDDAKVGVQDRGFLFGDGVYDVIKIYNGNPFRLLSHLERLQRSCNAISIELPHSIGDVEVVVGNLIKESACKDGFIYMQVTRGCAPRDHFFPIGVEPTFLIYILDLGFPSTKSSLKVTACITLPDERWMNCHIKSTNLLPNVLSLQKAKEAGAGEAILYRPDGTVTEGTRTNIFAVIDGIVRTHPESPLILPGITRNIALDIFKEANVAVLEEAFSTDDLSRASEVWTTSTGLEISPVNKIDGRVVDAAAPGSVCSLLLDHFWQKVEEECGV

SEQ ID NO: 199 - DNA, 858 bp, Unknown
  Obtained from environmental sample
ttgaaaaatttggcctggttaaacggcagtatttgtgatatttctgaagcaagggttccgcttgaagaccggggcttcttttttggcgacggggtatatgaggtaattaaaatatataatggtaagccattttatttggttccacatttaaaaaggcttcaaaacagcaccagtgctatcgagattgatcttccctctacgatcgaggaaattaaaataagtattgctgatttaattaaaaagagcgaaatcctgaatgggtatctctacatgcagataacaaggggttgtgcagaaagggaccatttgccccctgcagatatcaagccttcgatgatcatgtatgtcagggagtttgatgcacctgcttcagtactggatcattttaaaccggccagttgtattaccctgccggatgaaagatggcttcactgtaatattaaatcggttaatttgctgcccaatattctggccaggaaaaaagctgctaaagcaggtgctgtagaagcaatactataccgtccgggaggggtcgttacagaagggaccaggaccaatatatttgccgtgatcgatggcaaagtccgtacccatccggaatcaaatttaattttatcgggcattaccaggagtatcgttattgacattatgagcaagcagcaggtcccctttcttgaagaagcaattaatgtagaggaactaaaacaggcgtctgaagtgtggacaacctcttcgggaatagaaatccacccgatcagtattatagatgggcgaacggtgagtgaggatataccaggccctgtctgccggcatttgattgcagaatttcggaaaatcatagaagcagagtgttattaa

SEQ ID NO: 200 - protein, 285 aa, Unknown
  Obtained from environmental sample
  DOMAIN (8)...(277): Aminotransferase class IV
  SITE (8)...(11): N-glycosylation site. Prosite id = PS00001
  SITE (55)...(58): N-glycosylation site. Prosite id = PS00001
MKNLAWLNGSICDISEARVPLEDRGFFFGDGVYEVIKIYNGKPFYLVPHLKRLQNSTSAIEIDLPSTIEEIKISIADLIKKSEILNGYLYMQITRGCAERDHLPPADIKPSMIMYVREFDAPASVLDHFKPASCITLPDERWLHCNIKSVNLLPNILARKKAAKAGAVEAILYRPGGVVTEGTRTNIFAVIDGKVRTHPESNLILSGITRSIVIDIMSKQQVPFLEEAINVEELKQASEVWTTSSGIEIHPISIIDGRTVSEDIPGPVCRHLIAEFRKIIEAECY

SEQ ID NO: 201 - DNA, 855 bp, Unknown
  Obtained from environmental sample
atggaaatatgttatttaaatggtgactatattcccagggatgaggtaaggatcaatcctgacgatcgcggattcctctttgcagaaggcatctatgaagtggtaagatggtatgaagggtttttttacgatatggaaagccatctcggcaggatgaaaaggagtctcagtgaaataaagattcaatggcccggggaagattcctttcctgcaattgccatggaactgataaggttaaacaatcttgaaaatacacctgccctcatttacctgcaggttacaagaggttctgcgaaaagaacacattcattccccgatcctccggtaaaccctactgtttacgcatttgcaacaggttttgttccagaaaacagtgggaaggaatcaggtattggcattatgctgaaagaagatataaggtggagccgctgcgatattaaatcaatcgcccttcttccgaatacgctttgttttcaggaagctgtcgacaaaggttacttcgagtgtgcatttgtcagaaacggaatcatcaccgaatgtacccattcaaatatcttttttgtgatcaaaggtgttatttacacgcatcctgaatcggtttatgtcctgtcgggcattaccagaaaaaatataattcgtgttgccagaaaagcagaaattaccgttatagaagaggcagtatcagaaaagatgctcggcgatgttcaggaaatattcattacgaacacttccggcgaaataacccctgttataaatgtcggttcggtggttattggcaatggaattaccggacctgtcacaaggatcatcagggaacgattcaatgatgaaatatgctccatcaaacattcctga

SEQ ID NO: 202 - protein, 284 aa, Unknown
  Obtained from environmental sample
  DOMAIN (7)...(275): Aminotransferase class IV
  SITE (245)...(248): N-glycosylation site. Prosite id = PS00001
MEICYLNGDYIPRDEVRINPDDRGFLFAEGIYEVVRWYEGFFYDMESHLGRMKRSLSEIKIQWPGEDSFPAIAMELIRLNNLENTPALIYLQVTRGSAKRTHSFPDPPVNPTVYAFATGFVPENSGKESGIGIMLKEDIRWSRCDIKSIALLPNTLCFQEAVDKGYFECAFVRNGIITECTHSNIFFVIKGVIYTHPESVYVLSGITRKNIIRVARKAEITVIEEAVSEKMLGDVQEIFITNTSGEITPVINVGSVVIGNGITGPVTRIIRERFNDEICSIKHS

SEQ ID NO: 203 - DNA, 921 bp, Unknown
  Obtained from environmental sample
atgctggaagaacgccaggtatggatcaatgggcagttcgtgccgtgggcccacgccacggtgcacatgatgtgccacagctttgcgcggggctccacgatattcgaagtgatcagcttctatgccgcagcggccggcggtccggccgtcttccggctgcacgatcatgtggcccgcttcgaaaaatcagccgcctacctcgccatggagctgcccgtggggcacgacgctctttgtcgggcggtggccgagaccgtgcgccgcaaccggctggagcaggggacgctcaaggtcgtcggctattatccgcagtttgcgctcgacgtccagccgccgcagcagcggctgtcgatcgccgtattcgcgatggacccctcccgggacattccggaactcgggttttcgtttgagcagggcaccacggcgggcatcgcccgctggcgcaagctggacccccaaagcgttccgattgaggccaaggcggccgccaactatctcaacgggatggttgccaagctggaggtccagaagcgcggcttcgaggatgccatcctgctcgacacccagggcttcattgccgagggggcgaccgaatcgatctttttggtccagagcggccgcctgctgaccccatcgctcggcacggtgctggacagcatcacgcggcgcagcatattgcaggtggcggaccacctcgggatcgacgccttcgaaggccgcctgcggccggagctgctgttcgaggcggacgaggttttctttgccaacacccccttcaaggtgatccccgtacggcgcatcgaggagcgcgagatgccggctgtgccggggcctgttcaggcgaggctctatgggtttttggcccgggcggcgcgcggcgaagaagcggcgttcaaggagtggttgtacccggtagcgtaa

SEQ ID NO: 204 - protein, 306 aa, Unknown
  Obtained from environmental sample
  DOMAIN (10)...(288): Aminotransferase class IV
MLEERQVWINGQFVPWAHATVHMMCHSFARGSTIFEVISFYAAAAGGPAVFRLHDHVARFEKSAAYLAMELPVGHDALCRAVAETVRRNRLEQGTLKVVGYYPQFALDVQPPQQRLSIAVFAMDPSRDIPELGFSFEQGTTAGIARWRKLDPQSVPIEAKAAANYLNGMVAKLEVQKRGFEDAILLDTQGFIAEGATESIFLVQSGRLLTPSLGTVLDSITRRSILQVADHLGIDAFEGRLRPELLFEADEVFFANTPFKVIPVRRIEEREMPAVPGPVQARLYGFLARAARGEEAAFKEWLYPVA

SEQ ID NO: 205 - DNA, 825 bp, Unknown; identical to SEQ ID NO: 183
  Obtained from environmental sample

SEQ ID NO: 206 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 207 - DNA, 825 bp, Unknown
  Obtained from environmental sample
atgacgacgactgcttttttcaatggacgctacatcgacgtcgatgaggccgtcatccccatcgaggagcgcggccacaacttcggtgacggcatttacgacgtgatccgcgtgtacaacggcatcccgtttttcatggaggagcatctcgaccgcattttcatgagcgcccgcgagattcggctcgacattgggtatgaccgtgacgggttccgtcagctgttgcttgacgcggtcgccacacacggcggcacaaacgtcgacatctacctgcaggtgacgcgtggaatcgcgacgcgcgcgcacgcgttcccgcaggccaacgcatcggtgagcatcatcgtgcgtccctcccccgcgtacaccggcacgcatgacgcgatgctgcaccccgacgagcgatgggcaaactgctacatcaaatcactcaacctgctgccgaacatcctcgccttccagacagcgcaagaaaacggctgttgcgaggccatcctcgtcaaggacgggcacgtcacggagggttcgcgcacgtcggtgatgatggtcaaggacggcgaagtgtgggcgccggtgctgacacagcagatcctgtcgagcatcacccgcatagccgtgaaaaaggccgcagggctcgccgggattccgtttgtcgagaagaacttcacacccgacaccctgcttgatgccgacgaagtgttcatcgccggaacgggtagcgaaatccaccccatccaccggatcgacggtcagaggataggcaacggcgagaccggccctgtcgtgtcaaccctcaccgacggattcttccgcctgaccgccagttga

SEQ ID NO: 208 - protein, 274 aa, Unknown
  Obtained from environmental sample
  DOMAIN (8)...(269): Aminotransferase class IV
  SITE (109)...(112): N-glycosylation site. Prosite id = PS00001
MTTTAFFNGRYIDVDEAVIPIEERGHNFGDGIYDVIRVYNGIPFFMEEHLDRIFMSAREIRLDIGYDRDGFRQLLLDAVATHGGTNVDIYLQVTRGIATRAHAFPQANASVSIIVRPSPAYTGTHDAMLHPDERWANCYIKSLNLLPNILAFQTAQENGCCEAILVKDGHVTEGSRTSVMMVKDGEVWAPVLTQQILSSITRIAVKKAAGLAGIPFVEKNFTPDTLLDADEVFIAGTGSEIHPIHRIDGQRIGNGETGPVVSTLTDGFFRLTAS

SEQ ID NO: 209 - DNA, 1374 bp, Unknown
  Obtained from environmental sample
atggcccaggcacccgtttctaccgacattcgcgcggcattcgaggagcggttcgccggctcccgggccatgtacgagcgatcccgccaggtcatcccgagcggcatcacccacgacggccgctacctccgccccttcccgatctacgtccagcgcgccgccggcgcccacaagtggtccgtcgatggccatgaactgatcgactactccatgggccacggctccctcatcctcggccacaacgacccggacgtcatcgccgcggtccaagcggccctgccaagcggcacccacttcggcgccgggcacgaaggcgaagtcgcctgggccgagcagatcgtgaagatgctgcgaagcgccgagaaggtgaagttcaccctctccggcaccgaagccaccctcctcgcaattcgcgtcgcccgcgcctacaccggcaagaccgttattctcaagttcgaaggccatttccacggctggaacgactacctcctcaagggcgagcggccaccctttgaaggcgcgccgatgcccggcatcccgcgcgagactctggacacggtcgcggtcgtcccggccgatctcgcctatgtcgaagagcgcctcagtcagggcgacatcgccggcgtcatcatcgaaccgagcggcggctcctgggctaccgttcccctgccggacggcttcctcgcgggcctccgcgccctcacgaccaagtacaacgccccgctcatcttcgacgaggtcatcaccggattccgctgggcccccggcggcgcccaggagttctacggcatcactccagacctcaccaccctcgccaagatcgtggccggcggcatgcccggcggcgccgtcgccggttcggccgcgctgatgaagcacctcgagttctcggatgagcccggttggaacgccacccgcaaggtccgccaccagggaacctacaattccaatccggtcgccgccgccgccgccctcgcttgcctcacgaagtgcgaagaccccggcgtgcagcagacctgtaacgatctcgcccgccggctccgcatcggcatgaacggcattctggcggaacggggcgctcccggcatcgtctggggcgacagctccgtcttccacgtcgtcctcggcgaggccagcgaggacgtcaccaagggcgacgtccgctaccccacaggcaagtccgccgaagctctcaaatcctccggccagggcccgctaaccgccacgctgcaccaaggcatgctcctcgaaggcgtcgacttcttcgcctccggcggcatgctcagcgtcgcccacaccgacgccgacctcgatcacacccttgccgccttcgatcgcgtcgtgcgccgcatggccgaccagggccttttctaa

SEQ ID NO: 210 - protein, 457 aa, Unknown
  Obtained from environmental sample
  DOMAIN (49)...(377): Aminotransferase class-III
  SITE (307)...(310): N-glycosylation site. Prosite id = PS00001
MAQAPVSTDIRAAFEERFAGSRAMYERSRQVIPSGITHDGRYLRPFPIYVQRAAGAHKWSVDGHELIDYSMGHGSLILGHNDPDVIAAVQAALPSGTHFGAGHEGEVAWAEQIVKMLRSAEKVKFTLSGTEATLLAIRVARAYTGKTVILKFEGHFHGWNDYLLKGERPPFEGAPMPGIPRETLDTVAVVPADLAYVEERLSQGDIAGVIIEPSGGSWATVPLPDGFLAGLRALTTKYNAPLIFDEVITGFRWAPGGAQEFYGITPDLTTLAKIVAGGMPGGAVAGSAALMKHLEFSDEPGWNATRKVRHQGTYNSNPVAAAAALACLTKCEDPGVQQTCNDLARRLRIGMNGILAERGAPGIVWGDSSVFHVVLGEASEDVTKGDVRYPTGKSAEALKSSGQGPLTATLHQGMLLEGVDFFASGGMLSVAHTDADLDHTLAAFDRVVRRMADQGLF

SEQ ID NO: 211 - DNA, 1137 bp, Unknown
  Obtained from environmental sample
ttgaaaaatccagaggtgtatgccattagctggaaaggttttcttccaaggcatctattccaaattggtttaaccagttatgtccttatgggccatggtgaagttcatgctggtcctgaagggatggagatcatagactgtggattggggacaaatcctcttggaatgccgccttcaatgtgggatgctttaaaggtattgcctgaggttgatctctcttgttacccatctccagagccggagaggttgaaaaaatccatcgttgaagcctatccttgttggcatttggatgcaaatcaaatcctcaccggtagaggatccatggccgttctgaccgctcttttacggctactccttccgcctggttcggtgctttccggtccttctccccagttcacggatgttgtgcttcaggcgctgttccatggggcaatctatgaccccgttgttctaaaaaaacctgcttttaccttgaatgtggaagatttaatgtccatattggggaaaaagccttctgttttgtacctagaccgaccccataatccgacaggacaagtactgcctttagatgaattggagacggtgactaaagaggccttggaaaaaggggtctgggttctcgtggacgaagcttatggcgactatctcctccctgatgaatctgcctgttctttgaactacccaaatctcatcaccagccgttctttttccaagggcttgggggctgcgggcttaagggtgggctatgcggtttgccgtgatgaggagttgacggccctttttcggaaagtcacccctcctttttctgtgagccgccttgatgaggagctagccgtagcggttctcaaggacacacattttttgagtgagacgcgaagctatgtgatggaagcaaagagaaggattatcaatgtgatcaaaggaaagcttgattggattgtagccgacacggacatgcgcacacccattttctttctttcccaacgttccggggatctggtggcgcggctctatgccgcaggcatcatctgcgagcctggaagcggatttatgggactcgacaaccgatttgccagacttcgcgtccctgctccagattctttggatctctttctggaacgtctcgcgcacgcctaa

SEQ ID NO: 212 - protein, 378 aa, Unknown
  Obtained from environmental sample
  DOMAIN (42)...(375): Aminotransferase class I and II
  SITE (238)...(251): Aminotransferases class-I pyridoxal-phosphate attachment site. Prosite id = PS00105
MKNPEVYAISWKGFLPRHLFQIGLTSYVLMGHGEVHAGPEGMEIIDCGLGTNPLGMPPSMWDALKVLPEVDLSCYPSPEPERLKKSIVEAYPCWHLDANQILTGRGSMAVLTALLRLLLPPGSVLSGPSPQFTDVVLQALFHGAIYDPVVLKKPAFTLNVEDLMSILGKKPSVLYLDRPHNPTGQVLPLDELETVTKEALEKGVWVLVDEAYGDYLLPDESACSLNYPNLITSRSFSKGLGAAGLRVGYAVCRDEELTALFRKVTPPFSVSRLDEELAVAVLKDTHFLSETRSYVMEAKRRIINVIKGKLDWIVADTDMRTPIFFLSQRSGDLVARLYAAGIICEPGSGFMGLDNRFARLRVPAPDSLDLFLERLAHA

SEQ ID NO: 213 - DNA, 849 bp, Unknown
  Obtained from environmental sample
atggatgcgcttggttattataacggaaaatggggccctcttgatgaaatgaccgtgccgatgaatgaccgcggctgttattttggagatggggtgtacgatgccgcgttggcctataacggggtgatttttacgctggacgaacatattgacaggttttttaacagcgccaaactgcttcaaatagaactctcttatacaaaagatgagctaaaaaagatcctggacgaaatggtaagcaagcttgatgaaaaatgcctctttgtctattggcaggcaacccgtgggacggaaaggcggaatcatgtttattccgggggtacatccaatctttggatcatgataaaaccagctccaatagttgaccttaccgtaaagcttaagcttattaccgtagaagatacacgttatctccattgtaatataaaaaccattaaccttattcccaacatcattgccgcccaaaaagcggcggaagcaggatgctatgaagctgtttttcaccggggcgaaatcgtaaccgaatgtacccgcagcaatgttcatatcataaagaacgggatttttattacccatcccgcagacaacctgatactgcggggaattgcgcgcagtcatcttatcaaagcctgtaacgttctggggattcctgtgcaggaacggaaatatactcttgcggagctttttgatgcggacgaggttcttgtttccagtacaggcagcatgtgcctttccgcggaaacggcagacggaaaaaatgttggcgggaaagcgcccgaattggttaaaaagctgcaggataaagtgtttggtgaattctgcgaagttacgggatacaaaaaactttaa

SEQ ID NO: 214 - protein, 282 aa, Unknown
  Obtained from environmental sample
  DOMAIN (8)...(270): Aminotransferase class IV
MDALGYYNGKWGPLDEMTVPMNDRGCYFGDGVYDAALAYNGVIFTLDEHIDRFFNSAKLLQIELSYTKDELKKILDEMVSKLDEKCLFVYWQATRGTERRNHVYSGGTSNLWIMIKPAPIVDLTVKLKLITVEDTRYLHCNIKTINLIPNIIAAQKAAEAGCYEAVFHRGEIVTECTRSNVHIIKNGIFITHPADNLILRGIARSHLIKACNVLGIPVQERKYTLAELFDADEVLVSSTGSMCLSAETADGKNVGGKAPELVKKLQDKVFGEFCEVTGYKKL

SEQ ID NO: 215 - DNA, 1386 bp, Unknown
  Obtained from environmental sample
atggtccaggaacagaccctcacgattgaggagcaattcatcgccgagcacccacgctcatatgagctctaccagcgcagccgcgcggcggtgcccggcggcatcacccacgacgttcgatatgccaagcctttcccgatttatgtcgaccaagccctcggctcgaagaagtgggatgtcgacggtcacgaactgatcgactacacgatgggccacggttccctcatcctcggccacagccatcccgagatcgtcgatgcagtcgtcgcgcagatgcgcaaggggacccactacggcgcgggccaccgcctggaagtcgagtgggccgaatgggtccatcgcctcatcccctcggccgagcgggtcaagttcacctcctccggaaccgaggcgacgatgctggccctgcgcctcgcgcgcgcctacaccggtcgcgaccggatcatgaagttcgccgggcacttccacggctggcacgactacgccatccccggcaatcagccgccattcgaccagccgccgccgggcgtcccggccgccgtgctcggcacgatcgcgctcgccccgaataatgacctcgggtttgtcgagcgcacactggccgatcccgatcacgacatcgccgccgtcatcctggagccgagcggcgcgtcctacgccacggtgccgctgccggatggtttcttgcagaagctgcgcgagatcaccgcgcgccacaatgtgctgctgatcttcgacgaggtcgtgaccggtttccgctggtcgcccggcggtgtgcaggggctgaccgggatcacgcccgatctgacgacgatggcgaagatcctggccggtggcctgccgggcggcgcagtcgccgggcgagcaccgatcctcgaactgctggagttcaaggacgaccccacctggaatcgcacccgcaaggtcgcgcaccccggcacctacaacgccaaccccctctcggcggcggccggcgtgacggcgctgcgcctcgtttccgacccggccgtgcagcgcggggccgagcgcctggcaagtagcctgaagcgcggattcaacgaggcgctgctgcgtcacgaggtccccggcttcgcctacggcgagagttcgatcgtcaacaccgtgatcggcacgcgctatcccggcagcctgccgctcgacctgaagcacccggtcggcgtggatccaatcgttctgaagcggggcggctcgcaagagttaacgcagtcgctgcacgccgcgatgatgatcgaggggatggacctctggcacggtgcgggcgcgatcctcagcatcacccacaccgatgaggatgtcgcgcgcaccgtcgaggcgttcgaccgcactctgggccgaatgcgcgccgaaggccattttccggattga

SEQ ID NO: 216 - protein, 461 aa, Unknown
  Obtained from environmental sample
  DOMAIN (48)...(376): Aminotransferase class-III
  SITE (308)...(311): N-glycosylation site. Prosite id = PS00001
MVQEQTLTIEEQFIAEHPRSYELYQRSRAAVPGGITHDVRYAKPFPIYVDQALGSKKWDVDGHELIDYTMGHGSLILGHSHPEIVDAVVAQMRKGTHYGAGHRLEVEWAEWVHRLIPSAERVKFTSSGTEATMLALRLARAYTGRDRIMKFAGHFHGWHDYAIPGNQPPFDQPPPGVPAAVLGTIALAPNNDLGFVERTLADPDHDIAAVILEPSGASYATVPLPDGFLQKLREITARHNVLLIFDEVVTGFRWSPGGVQGLTGITPDLTTMAKILAGGLPGGAVAGRAPILELLEFKDDPTWNRTRKVAHPGTYNANPLSAAAGVTALRLVSDPAVQRGAERLASSLKRGFNEALLRHEVPGFAYGESSIVNTVIGTRYPGSLPLDLKHPVGVDPIVLKRGGSQELTQSLHAAMMIEGMDLWHGAGAILSITHTDEDVARTVEAFDRTLGRMRAEGHFPD

SEQ ID NO: 217 - DNA, 825 bp, Unknown; identical to SEQ ID NO: 183
  Obtained from environmental sample

SEQ ID NO: 218 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 219 - DNA, 861 bp, Unknown
  Obtained from environmental sample
atggacgcactgggatattacaacggaaattgggggcctctggacgagatgactgtgccgatgaacgacaggggctgctactttggagacggcgtatacgacgctacctgcgccgttaacggagttatttttgccctggatgagcacattgacaggtttttcaacagcgcaaagctcctggaaataaatattagcttaacaaaagaggaattgaaaaaaactttaaatgaaatgtactccaaagtggataaaggagagtacctggtttattggcaggtgactcgcggaacaggccggcgaagccatgtatttccggcaggcccttcaaatctctggattataattaagcccaatcacatcgacaatctttatagaaaaatcaagctcattaccatggatgatacccgcttcctacactgcaacatcaagacccttaaccttatacccaatgtcattgcttcccagcgggcgctggaagcgggttgccacgaggcggtatttcaccggggcgaaacggtaaccgagtgcgctcacagcaatgtccatatcattaaaaacggcaggtttattacccatccggcggacaacctgatcctccggggtacagcccgcagtcatttattgcaggcctgtgtcaggcttaacattccggtagacgaacgggaattttccctttcggaattattcgacgcggacgaggtgcttgtgtccagcagcggcacactcggccttagcgccgaagaaatcgacggaaaaaaagcgggagggaaagcgcctgaactgctaaaaaaaatccaggatgaagtgctgagggaatttatcgaagcgacaggctacacgcctgagtggagcagggtatag

SEQ ID NO: 220 - protein, 286 aa, Unknown
  Obtained from environmental sample
  DOMAIN (8)...(270): Aminotransferase class IV
  SITE (63)...(66): N-glycosylation site. Prosite id = PS00001
MDALGYYNGNWGPLDEMTVPMNDRGCYFGDGVYDATCAVNGVIFALDEHIDRFFNSAKLLEINISLTKEELKKTLNEMYSKVDKGEYLVYWQVTRGTGRRSHVFPAGPSNLWIIIKPNHIDNLYRKIKLITMDDTRFLHCNIKTLNLIPNVIASQRALEAGCHEAVFHRGETVTECAHSNVHIIKNGRFITHPADNLILRGTARSHLLQACVRLNIPVDEREFSLSELFDADEVLVSSSGTLGLSAEEIDGKKAGGKAPELLKKIQDEVLREFIEATGYTPEWSRV

SEQ ID NO: 221 - DNA, 837 bp, Unknown
  Obtained from environmental sample
atggatatagcatatttcaatggcactttcattcccagggatgagatcaggataagtcctgatgaccgcggatttctgtttgcggaaggtatttatgaagtagtaaggtggtaccagggattcttttttgatatggatggtcatgtggcaaggatgaaaaggagtcttagggaaactctgatttcgtggccggaggaagaaaaattcccggtaattgccagggaactggttaagctgaatcatcttgagaattcacaggctcttgtttatcttcaggtaacaagaggagccgcaagccgtacccatgcatacccttcgccccccgtaagtccgacagcctatgcgtttgcaagggaattcacacccgagaatgccggcagggagtcgggagttgccataactgttaaggaagacatcagatgggcacgctgcgacatcaaatccattgcccttttacccaacaccctgggttttcaggatgccgtcagcaatggtttctttgaatgtgccttcgtcaggaacggattaatcactgaatgctcacattccaatatcttctttgttcagaaagggattgtctatacccatcctgaatcggaaagcatattatccggcatcaccaggaaaaacttaatcaaactggcccgcagggagggcatccccgtaaaggaggaagctatagctctcgcaaaactatcgaaggttcaggagatatttattaccaacacatcaggtgaaatcacccctgtggtcagggtggataattttgagatcggaggcggagttccgggacctgtaaccagaatactcagggaacggttcaacgatcagatccaa

SEQ ID NO: 222 - protein, 279 aa, Unknown
  Obtained from environmental sample
  DOMAIN (7)...(275): Aminotransferase class IV
  SITE (7)...(10): N-glycosylation site. Prosite id = PS00001
  SITE (245)...(248): N-glycosylation site. Prosite id = PS00001
MDIAYFNGTFIPRDEIRISPDDRGFLFAEGIYEVVRWYQGFFFDMDGHVARMKRSLRETLISWPEEEKFPVIARELVKLNHLENSQALVYLQVTRGAASRTHAYPSPPVSPTAYAFAREFTPENAGRESGVAITVKEDIRWARCDIKSIALLPNTLGFQDAVSNGFFECAFVRNGLITECSHSNIFFVQKGIVYTHPESESILSGITRKNLIKLARREGIPVKEEAIALAKLSKVQEIFITNTSGEITPVVRVDNFEIGGGVPGPVTRILRERFNDQIQ

SEQ ID NO: 223 - DNA, 867 bp, Unknown
  Obtained from environmental sample
atgtatccaattattttaacgcaaggtaaattccttcataaagatagcctaacatttccgatggaagaacgaggtttacaatttggcgacggtgtttacgaagtcattcgcctttataagggaaagccatatttattagatgaacatatcgagcgactttatcgttctttgcaggcaatacggattcaaatacattatacgcatgacgaaatggtagcaatgttacgcgatttgattcaacgcaatgaaattgataaggacggcattatttatttacaaatcacgcgtggctcggcgccccgtttgcacgtttttccggaaaatacgactcccaacttgtacgcatatgcaaaaaaacaaccacgttatacccattttttggaaaatggagttaaggctattacattagcagatgaacgttgggataattgctatattaagagtttgaatttgcttccaaacgtgcttgccaaacaaacggctgctgaactggaagcgtatgaagcgattttacaccgagatggtattgtgacagaatgtagttcctcgaatttgtttctagtgaaaaatggaactatttatacgcatccagcggaaaaacggatcctaaacggttgtgtccgcatggcagttaaacgtctcgctgaaaagttaagcctcccgtttatagaagaggccttcactttggacgatattgtttctgccgatgaactatttttaacgagtagtatttcagaggtgatgccgattgtgcaagtaaatgacaaacaggttgcaagtgggatgccaggaaagataacgcgccaacttcaacaagcttatgaagaagatgcaaagctaactttacaaaaagtatcttcgccctga

SEQ ID NO: 224 - protein, 288 aa, Unknown
  Obtained from environmental sample
  DOMAIN (8)...(275): Aminotransferase class IV
  SITE (192)...(195): N-glycosylation site. Prosite id = PS00001
MYPIILTQGKFLHKDSLTFPMEERGLQFGDGVYEVIRLYKGKPYLLDEHIERLYRSLQAIRIQIHYTHDEMVAMLRDLIQRNEIDKDGIIYLQITRGSAPRLHVFPENTTPNLYAYAKKQPRYTHFLENGVKAITLADERWDNCYIKSLNLLPNVLAKQTAAELEAYEAILHRDGIVTECSSSNLFLVKNGTIYTHPAEKRILNGCVRMAVKRLAEKLSLPFIEEAFTLDDIVSADELFLTSSISEVMPIVQVNDKQVASGMPGKITRQLQQAYEEDAKLTLQKVSSP

SEQ ID NO: 225 - DNA, 861 bp, Unknown
  Obtained from environmental sample
ttggacgcgctgggatattacaacggaaaatggggccccctggacgaaatcaccgtgccgatgaacgacagaggctgctacttcggagacggcgtgtacgatgccgcctgcgcggctaacggagtgacatttgcactggatgagcacattgaccgttttttcaacagcgcagaactcctggaaataaaaatcaatttaacaaaagaagaactgaaaaaaaccctcaatgaaatgtgctccaaagtggataagggagtgtacctggtttattggcaggtaacccgcggaacaggccggcgaaaccatgtatttcctgaaggcccctcaaatctctggattatgataaagccctatcccttatacgatctttataaaaaaataaagctcatcacaatggaagatacccgttttctccactgtaacattaagaccattaaccttattcccaatgtcattgcctcccagcgggcgctggaagcggactgctttgaaacggtatttcaccggggcgaaacagtaaccgagtgcgcccacagcaatgtccacatcctcaaaaacggcaggtttatcacccatcaggcggacaatctgatcctccggggcattgcccgtagccatatattgcaagcctgcgacaggctgaaaatcccggttgacgaacgggagtttaccctttcggaattgtttgacgcggacgaggcgattgtgtccagcagcggtgatttctgcgtcagcgccgaaataatcgacggaaaaagcgtgggagggaaagcgcctgaactgcttagaaaaattcaggacgaagtgctgagggaatttaccgaagcaactggctataagcctgaggggagtaaggtataa

SEQ ID NO: 226 - protein, 286 aa, Unknown
  Obtained from environmental sample
  DOMAIN (8)...(270): Aminotransferase class IV
MDALGYYNGKWGPLDEITVPMNDRGCYFGDGVYDAACAANGVTFALDEHIDRFFNSAELLEIKINLTKEELKKTLNEMCSKVDKGVYLVYWQVTRGTGRRNHVFPEGPSNLWIMIKPYPLYDLYKKIKLITMEDTRFLHCNIKTINLIPNVIASQRALEADCFETVFHRGETVTECAHSNVHILKNGRFITHQADNLILRGIARSHILQACDRLKIPVDEREFTLSELFDADEAIVSSSGDFCVSAEIIDGKSVGGKAPELLRKIQDEVLREFTEATGYKPEGSKV

SEQ ID NO: 227 - DNA, 861 bp, Unknown
  Obtained from environmental sample
atggaagcgctgggatactacaacggaaaatggggccccctggacgagatgaccgtgccgatgaatgacagaggctgctactttggagacggcgtgtacgacgccgcctgcgccgctaacggagtgatctttgtcctggatgaacacattgaccgctttttcgacagcgcaaagctcctggaaataaaaatcaatttaacaaaagaggaactaaagaagacccttaatgaaatgtgctccaaagtgaataagggagtgtacctggtttattggcaggcgacccgcggaacaggccggcgggatcatgtatttccggcaggcccctcaaatctctggattatgataaagccttatcccttatatgatctttataaaaagataaagctcatcactatggaggatacccgctttctccactgcaacatcaagacccttaaccttattcccaatgtcattgcctcccaacgggcgctggaagcgggctgcgatgaaactgtatttcaccggggcgaaacggtaaccgaatgcgcccacagcaatgtccacatccttaaaaacggcaggtttatcacccatcaagcggacaatctgatccttcggggcatagcccgcggccatatattgcaagcctgcgacaggctgaatattccggttgatgaacgggagtttaccctttcggaattgtttgacgcggatgaggtgattgtgtccagcagcggtgatttctgctccagcgccgaaataatcgacggaaaaagcgtgggggggaaagcgccggaactggtaaaaaaaattcaggacgaagtgctgagggaatttaccgaggcgacaggctatacgcctgagtggagtaaggtataa

SEQ ID NO: 228 - protein, 286 aa, Unknown
  Obtained from environmental sample
  DOMAIN (8)...(270): Aminotransferase class IV
MEALGYYNGKWGPLDEMTVPMNDRGCYFGDGVYDAACAANGVIFVLDEHIDRFFDSAKLLEIKINLTKEELKKTLNEMCSKVNKGVYLVYWQATRGTGRRDHVFPAGPSNLWIMIKPYPLYDLYKKIKLITMEDTRFLHCNIKTLNLIPNVIASQRALEAGCDETVFHRGETVTECAHSNVHILKNGRFITHQADNLILRGIARGHILQACDRLNIPVDEREFTLSELFDADEVIVSSSGDFCSSAEIIDGKSVGGKAPELVKKIQDEVLREFTEATGYTPEWSKV

SEQ ID NO: 229 - DNA, 873 bp, Unknown
  Obtained from environmental sample
atggatgcgctgggatattacaacggaaaatggggccccctggacgagatgaccgttccgatgaacgacagaggctgctatttcggagacggcgtgtacgacgcagcctgcgcggctaacggagttatctttgtcctggatgagcacattgaccgctttttcgacagcgcaaagctcctggaaataaaaatcaatttaacaaaagaggaactaaagaaaaccctcgataaaatgttctctgaaatgtgctccaaagtgaataagggagtgtacctggtttattggcaggcgacccgcggaacaggccggcgggatcatgtatttccggcaggcccctcaaatctctggattatgataaagccttatcccttatacgatctttataaaaaaataaagctcatcactatggaagatacccgctttctacactgcaacatcaagacccttaaccttattcccaatgtcatagcctcccagcgggcgctggaagcgggctgcgacgaaacggtattttaccggggcgaaacggtaaccgaatgcgctcacagcaatgtccacatcctcaaaaacggcaggtttatcacccatcaggccgataatctgatccttcggggcatagcccgcagccatatattgcaagcctgcggcaggctgaatattccggttgaggaacgtgatttcaccctttcggagttgtttgacgcggacgaggtgattgtgtccagcagcggtgatttctgcaccggcgccgaaataatcgacggaaaaagcgtgggggggaaagcgccggaactgctaaaaaaaattcaggacgaagtgttgagggaatttaccgaggcgacaggctatacgcctgagtggagtaaggtataa

SEQ ID NO: 230 - protein, 290 aa, Unknown
  Obtained from environmental sample
  DOMAIN (8)...(274): Aminotransferase class IV
MDALGYYNGKWGPLDEMTVPMNDRGCYFGDGVYDAACAANGVIFVLDEHIDRFFDSAKLLEIKINLTKEELKKTLDKMFSEMCSKVNKGVYLVYWQATRGTGRRDHVFPAGPSNLWIMIKPYPLYDLYKKIKLITMEDTRFLHCNIKTLNLIPNVIASQRALEAGCDETVFYRGETVTECAHSNVHILKNGRFITHQADNLILRGIARSHILQACGRLNIPVEERDFTLSELFDADEVIVSSSGDFCTGAEIIDGKSVGGKAPELLKKIQDEVLREFTEATGYTPEWSKV

SEQ ID NO: 231 - DNA, 864 bp, Unknown
  Obtained from environmental sample
atggacgcactgggctattacaacggaaaatgggggcctctggacgagatgaccgtgccgatgaacgacaggggctgttactttggagacggcgtttacgacgctgcctgtgccgctaacggaacgatctttgccccggatgagcatatcgaccggtttttcaacggcgcaaagctcctggaaataaaaatcaatttaacaaaagaggaactgaaaaaaacccttaacgaaatgctctctaaagtggacaagggggagtacctggtttattggcaggtgacccgtggaacgggccgtcgaagccatgtatttccggcaggcccctcaaatctctggattatgataaagccccaccccatcgacgatctttataaaaaaataaagctcattaccatggaggacacccgctttctccactgcaacatcaagaccctcaaccttcttcccaatgtcatcgcctcccagcgggcgctggaagcggactgctacgaaacggtatttcaccggggcgaaacagtaaccgagtgcgcccacgacaatgtccacatcgtcaaaagcggcaggttcatcacccatccggcggataacctgatcctccgtggtatagcccgcagtcatttactgcaagcctgcgacaggctgaacattccggttgaagaacgggaatttaccatttcggaactgtttgacgcggacgaggttcttgtgtccagttgcggctctttcggtcttagcgccgatgcaattgacggaaaaggcgtgggaggaaaagcccctgaactgcttaaaaaaattcaggacgaggtgctgagggaatttatcgaagcgacaggccacgcgcctgcctggagcaagaaggtataa

SEQ ID NO: 232 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFNGAKLLEIKINLTKEELKKTLNEMLSKVDKGEYLVYWQVTRGTGRRSHVFPAGPSNLWIMIKPHPIDDLYKKIKLITMEDTRFLHCNIKTLNLLPNVIASQRALEADCYETVFHRGETVTECAHDNVHIVKSGRFITHPADNLILRGIARSHLLQACDRLNIPVEEREFTISELFDADEVLVSSCGSFGLSADAIDGKGVGGKAPELLKKIQDEVLREFIEATGHAPAWSKKV

SEQ ID NO: 233 - DNA, 822 bp, Unknown
  Obtained from environmental sample
atggacagatacatccagatcaacgatcagctcatttccgccgcacaggccacgctgggggtgaccgacctgtccattcatcgcggttacggcatttttgattttttcaaaaccatcggtaaccgccccatctttcttgaagaccacctcgaccgcttttttgtttccgcacacgaaatgctgctcgatgtgccctatacgagggaagagctgcgcctgatgatcgcccggctgacggagaagaataacctgcccgactccggcatcaagatcatccttaccggcggctatgctgacgatggttataccattagcgggccgcccaacctcatcatgcagcaaacgccgctcgttatcaaagatttttctgacgatggtatgcgcctcatcaccttccatcaccagcggcaggtgcccctggccaaaagcatcgactatgtgcaggccatccgcctgcagccgcttgtaagagctgaacaggctgacgatattctgtactactataacaacattgcaggcgagagcccgcgctccaacttttttatcgttaccggcaacgagatactcaccgcgcaaaacaacgtgctgatgggcgttacgcggaaaaagatactgtcgttaaacgtccccggttacaccgttaccgcgcgtgattttacgctggaggatgtgtttaacgccagagaggcctttatcagcagcaccaccaggcaggcccacccggtagtgatcatcgacggcaagcccatcggcaacggccggccgggaccggtagtgcgcgaaatcaaccggcagctttttgagctgatggagcgggagtaa

SEQ ID NO: 234 - protein, 273 aa, Unknown
  Obtained from environmental sample
  DOMAIN (8)...(267): Aminotransferase class IV
MDRYIQINDQLISAAQATLGVTDLSIHRGYGIFDFFKTIGNRPIFLEDHLDRFFVSAHEMLLDVPYTREELRLMIARLTEKNNLPDSGIKIILTGGYADDGYTISGPPNLIMQQTPLVIKDFSDDGMRLITFHHQRQVPLAKSIDYVQAIRLQPLVRAEQADDILYYYNNIAGESPRSNFFIVTGNEILTAQNNVLMGVTRKKILSLNVPGYTVTARDFTLEDVFNAREAFISSTTRQAHPVVIIDGKPIGNGRPGPVVREINRQLFELMERE

SEQ ID NO: 235 - DNA, 906 bp, Unknown
  Obtained from environmental sample
atgactgacgaacgcaaagtatggctgaacggtgacctgatcccctgggagaaagccacggtaccgctgttgtcccatggattttcgcggggctcggcgatgttcgatgtgtttatggtgtacaacagccccgacggtcccaaggcgtttcgaatggaccagcacctcaagcggctccagcgcagtgcggatcttttggggatggagatggcctattcgaccgaggagatcatccaggcggtgaagacagcggtcaaggccaaccgcctcacgcagggcatcgtgaagattatggcctattggggggaggaggcgctcatcgacctggtcctgaagtccaagctcgacctggccattttcacgatcccccacgggggcaccccgggggtggacaagcccaagcccatctcggcctgcatcaccaaatggaaaaaaattcacccgctgagcgtcccggtggcggccaaggcctgctccaactacctgaacggctatctggcccgcaaggatgccaacagccgcgggttcgatgtggggctcatggcgggaaccgacggtttcatggccgagggatcgatcgaatcgttctttatcgtcaaggacggcgtgctcaaaacccctcatctgggcccgatcctttcgagcatcacccgcatgtcggtgctggaagcggcccctacaatagacatcccggttgcccaggaggcgcttacgcccgaggacctctacaccgcggatgagatcttcacgggccactcgagcgtcaaggtctccccggtcgagcggttcgaggaccggacgctcaaggcgccgggtccggtcacccgcaagctcatgaacctgatggacgatgtcatcgccttcaaggacaatcgttttccgcattggtttcaggcactcagctag

SEQ ID NO: 236 - protein, 301 aa, Unknown
  Obtained from environmental sample
  DOMAIN (10)...(283): Aminotransferase class IV
MTDERKVWLNGDLIPWEKATVPLLSHGFSRGSAMFDVFMVYNSPDGPKAFRMDQHLKRLQRSADLLGMEMAYSTEEIIQAVKTAVKANRLTQGIVKIMAYWGEEALIDLVLKSKLDLAIFTIPHGGTPGVDKPKPISACITKWKKIHPLSVPVAAKACSNYLNGYLARKDANSRGFDVGLMAGTDGFMAEGSIESFFIVKDGVLKTPHLGPILSSITRMSVLEAAPTIDIPVAQEALTPEDLYTADEIFTGHSSVKVSPVERFEDRTLKAPGPVTRKLMNLMDDVIAFKDNRFPHWFQALS

SEQ ID NO: 237 - DNA, 837 bp, Unknown
  Obtained from environmental sample
atgagagaaattgtttttttgactggagaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggaaactgaaaatcttcaatccgtttttaactcactcataaccagaaataaccttaatgataaacatgcaggggtatatttacaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatataaaatcggtttcactgcttcccaatacaatgttgtataacaaagccgtaaaagccggggcgggagagtgcgttttaattcgcaatggaatggttaccgaagctacacattcaagcgttttgtgtgtaaaaaacggaattgttattacacgaccattatcaaatctgattcttcccggaattacaagaaaagttgtacaggagatatgctctgtccataatattgcttttgaagagcgcgaattttctgaaactgaattgcttgaaatggatgaaattataattgctggtacggggagtgaaataactccggcaatcaaggtaaacgaatcaactataggaaacggcaaaccaggcaaaatcacacggtttattcagcaaaagttttttgagatggtttaa

SEQ ID NO: 238 - protein, 278 aa, Unknown
  Obtained from environmental sample
  DOMAIN (8)...(275): Aminotransferase class IV
  SITE (1)...(4): Tubulin-beta mRNA autoregulation signal. Prosite id = PS00228
  SITE (257)...(260): N-glycosylation site. Prosite id = PS00001
MREIVFLTGEFLEKEAAKISPNDRGFIFADGVYEVAKYYNGRPFRYDDHLKRLERSLSELEIEYPETENLQSVFNSLITRNNLNDKHAGVYLQITRGEHKRVHHFPENVQPTVYAFAFELPSFKENLEKGIKVITHEDIRWQRCDIKSVSLLPNTMLYNKAVKAGAGECVLIRNGMVTEATHSSVLCVKNGIVITRPLSNLILPGITRKVVQEICSVHNIAFEEREFSETELLEMDEIIIAGTGSEITPAIKVNESTIGNGKPGKITRFIQQKFFEMV

SEQ ID NO: 239 - DNA, 843 bp, Unknown
  Obtained from environmental sample
atgaatgaaattgtttatttgaatggcgtatttatgccaaaagaagctgcaaaaatatcgccagacgatcgcggatttatttttgccgacggtgtttacgaagttgcaaaatattacaatggcaatccttttcggtttgaagatcatattctaaggctggaaagaagtctgcgggaacttgaaattgattatactgaaattgacggcttacaatctgtttttaatgagctgattaaaagaaataatttatttgataaacatgccggggtttatcttcagattacccgcggagtaaataaacgtgaacattattttcctgaaaatattaatccaacagtttacgcgtttgcatttgatttgccttcgtttaaaaataatcttgaaaatggaattaaagtaattactcacgaagatattcgctggctacgttgcgatataaaatctgtttcgcttttagcaaatacaatgctttataacaaagctataaaaaccggggcaggagaatgcatccttattcgcaacgggatggtaacagaggcaacacattcaagtgtattgggagttaaaaacggaatggtaattacatgtcctctttccaatttaattcttcccggaattacacgaaaagttatcatggaaatatgcactgcaggtaaaattccttttgaagaacgggaattttcagaaattgaaatgtacgatatggatgaaattataattgccggaaccggcagcgaaattactccagcaattcaggtgaacgataaaattattggaaacggcaatcccggaaaaataacccgctttattcaaaacagattttttgaaatggtgagagggtag

SEQ ID NO: 240 - protein, 280 aa, Unknown
  Obtained from environmental sample
  DOMAIN (8)...(275): Aminotransferase class IV
MNEIVYLNGVFMPKEAAKISPDDRGFIFADGVYEVAKYYNGNPFRFEDHILRLERSLRELEIDYTEIDGLQSVFNELIKRNNLFDKHAGVYLQITRGVNKREHYFPENINPTVYAFAFDLPSFKNNLENGIKVITHEDIRWLRCDIKSVSLLANTMLYNKAIKTGAGECILIRNGMVTEATHSSVLGVKNGMVITCPLSNLILPGITRKVIMEICTAGKIPFEEREFSEIEMYDMDEIIIAGTGSEITPAIQVNDKIIGNGNPGKITRFIQNRFFEMVRG

SEQ ID NO: 241 - DNA, 825 bp, Unknown; identical to SEQ ID NO: 183
  Obtained from environmental sample

SEQ ID NO: 242 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 243 - DNA, 825 bp, Unknown; identical to SEQ ID NO: 183
  Obtained from environmental sample

SEQ ID NO: 244 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 245 - DNA, 906 bp, Unknown
  Obtained from environmental sample
gtgttcaaacatgtcgatgcctatgccggtgacccgattctgtcgctgatggagaccttcaagaccgatccgcgtgccaacaaggtcaacctcagcatcggcctgtactacgacgcggccggcgtggtgccacaactggcagccgtgggcgaggcggagaagcgcctggccgacaagccccacgaagcctccctgtacctgccgatggaaggcctggccgggtaccgccaggccatccagaacctgctgttcggcgccgatcacccggcggtgaccagcggccgcgtcgccaccgtgcagacggtcggcggttccggcgcgctgaaggtcggtgccgacttcctcaagcgctatttccccgagtcgcaggtatgggtcagcaatccgacctgggacaaccaccgtgccatcttcgaaggtgccgggttcaaggtgaatacctacccgtacttcgaccaggcctcccgcggcgtcgacttcgacggcatgctggctaccctgcagaccctgccggccaacagcatcgtcctgctccacccgtgctgccacaaccccaccggcgtcgacctgacccaggcccaatggcagcaggtgatcgaagtggtcaaggcgcgcgagttgatcccgttcctcgacatcgcctaccagggcttcggcgaaggcctggtcgaggacgccttcgccatccgcgaggccgcccgtgccggcgtagcgtgcctggtcagcaactccttctcgaagatcttctcgctgtatggcgagcgggtaggggggctgtcggtggtctgcgacgatgcccagacccaggccagcgtactcggccagctcaaggccaccgtacgccgcaactactccagcccgcccaccttcggtgcgcaactggtggccacggtattgctcgtgccg

SEQ ID NO: 246 - protein, 302 aa, Unknown
  Obtained from environmental sample
  DOMAIN (26)...(302): Aminotransferase class I and II
  SITE (30)...(33): N-glycosylation site. Prosite id = PS00001
  SITE (247)...(260): Aminotransferases class-I pyridoxal-phosphate attachment site. Prosite id = PS00105
  SITE (287)...(290): N-glycosylation site. Prosite id = PS00001
MFKHVDAYAGDPILSLMETFKTDPRANKVNLSIGLYYDAAGVVPQLAAVGEAEKRLADKPHEASLYLPMEGLAGYRQAIQNLLFGADHPAVTSGRVATVQTVGGSGALKVGADFLKRYFPESQVWVSNPTWDNHRAIFEGAGFKVNTYPYFDQASRGVDFDGMLATLQTLPANSIVLLHPCCHNPTGVDLTQAQWQQVIEVVKARELIPFLDIAYQGFGEGLVEDAFAIREAARAGVACLVSNSFSKIFSLYGERVGGLSVVCDDAQTQASVLGQLKATVRRNYSSPPTFGAQLVATVLLVP

SEQ ID NO: 247 - DNA, 861 bp, Unknown
  Obtained from environmental sample
ttggacgcgctgggatactacaacggaaaatggggctcactggacgagatgaccgtgccaatgaacgacagaggctgctacttcggagacggcgtgtacgatgccgcctgcgcggctaacggagtaacctttgccctggatgagcacattgaccgttttttcaacagcgcagagctcctggaaataaaaatcaatttaacaaaagaggaactgaaaaaaaccctcaatgaaatgtgttccaaagtggataagggagtttacctggtttattggcaggtaacccgcggaacaggccggcgaaaccatgtatttcctgaaggcccatcaaatctctggattatgataaagccctatcccttatacgatctttatacaaaaataaagctcatcacaatggaagatacccgttttctccactgcaacattaagaccattaaccttattcccaatgtcattgcttcccagcgggcgctggaagcaggctgcgatgaaacggtatttcaccgcggcgaaacagtaaccgagtgcgcccacagcaatgtccacatcctcaaaaacggcaggtttatcacccatcaggcggacaatctgatcctccggggtattgcccgcagccatatattgcaagcctgcgacaggctgaaaatcccggttgacgaacgggagtttaccctttcggaattgtttgacgcggacgaggcgattgtgtccagcagcggtgatttctgcgtcagcgccgacacaatcgacgggaaaagcgtgggagggaaggcacctgaactgcttaaaaaaattcaggacgaagtgctgagggaatttaccgaagcaactggctatacgcctgagtggagtaaggcataa

SEQ ID NO: 248 - protein, 286 aa, Unknown
  Obtained from environmental sample
  DOMAIN (8)...(270): Aminotransferase class IV
MDALGYYNGKWGSLDEMTVPMNDRGCYFGDGVYDAACAANGVTFALDEHIDRFFNSAELLEIKINLTKEELKKTLNEMCSKVDKGVYLVYWQVTRGTGRRNHVFPEGPSNLWIMIKPYPLYDLYTKIKLITMEDTRFLHCNIKTINLIPNVIASQRALEAGCDETVFHRGETVTECAHSNVHILKNGRFITHQADNLILRGIARSHILQACDRLKIPVDEREFTLSELFDADEAIVSSSGDFCVSADTIDGKSVGGKAPELLKKIQDEVLREFTEATGYTPEWSKA

SEQ ID NO: 249 - DNA, 837 bp, Unknown
  Obtained from environmental sample
atgagcacagccgacccactcaccaagataatcccggccgaggccgccgattggccggttgtcctggatggggagctgatgcgggccggcgaggcgatgatccccgccggtgacgatggactgatccgaggcgacggcgcgttcgatgccttcccggtcgtggacggtcgcccgttcgcccgggcggcacatctggatcgcctcgagcgctcgtgcgcggcgctggacctgccgtgcccccgcgcgcagatcgagtccgacatcgacctgctgctgacccgggccggggacggctacctagcggtccgggtgctgctcacgcgcggcgggcaccggatctgccgcttggagccgcgcggcgagatatcggagctgaccaagccggtgcgcctgctgccggtcacctacaacccatcggtggtgctcaacggcgtcaagtcgctctcctacggggcaaacatgctggcctcgcggcgggcggtggccgccggctatggcgaggcgctgctggttcgctcggacgggatcgtgctcgagggacccacgtgctcgatcttctgggtacgcgatggccgccttcagacccccgcgctcgagaccgggatcctcgcctcgatcacccggcgggtgatcctcgagagcatggcggtcgaggagggcagcttctcgcttgagcacgcgctcggtgccgacgaggcgttcctggtctcgaccgcccgactcgggcagccgatcgccgcgatcggcgaggtgaccctgccctcggcgcccggcccgcagaccctcaaggcgcaggaagcgatcgcccgcgccatggccgagggctcgatcgcctga

SEQ ID NO: 250 - protein, 278 aa, Unknown
  Obtained from environmental sample
  DOMAIN (23)...(269): Aminotransferase class IV
MSTADPLTKIIPAEAADWPVVLDGELMRAGEAMIPAGDDGLIRGDGAFDAFPVVDGRPFARAAHLDRLERSCAALDLPCPRAQIESDIDLLLTRAGDGYLAVRVLLTRGGHRICRLEPRGEISELTKPVRLLPVTYNPSVVLNGVKSLSYGANMLASRRAVAAGYGEALLVRSDGIVLEGPTCSIFWVRDGRLQTPALETGILASITRRVILESMAVEEGSFSLEHALGADEAFLVSTARLGQPIAAIGEVTLPSAPGPQTLKAQEAIARAMAEGSIA

SEQ ID NO: 251 - DNA, 135 bp, Unknown
  Obtained from environmental sample
atgaaggtcatcgtgcttggcagcggcgtcatcggcgtgaccagcgcctggtatctggccgaggccggccacgaggtggtcgtgctcgaccgccagcccggcccggcgctcgagacgagcttcgccaacgccggc

SEQ ID NO: 252 - protein, 45 aa, Unknown
  Obtained from environmental sample
MKVIVLGSGVIGVTSAWYLAEAGHEVVVLDRQPGPALETSFANAG

SEQ ID NO: 253 - DNA, 1260 bp, Unknown
  Obtained from environmental sample
atgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctga

SEQ ID NO: 254 - protein, 419 aa, Unknown
  Obtained from environmental sample
  DOMAIN (9)...(401): FAD dependent oxidoreductase
  SITE (211)...(214): N-glycosylation site. Prosite id = PS00001
MTGRTADGTVIVVGAGIVGIACAHYLREAGLTVTVIDRGTIAGACSHANCGLICPSHLLPLTHPGAVRAALKSLFTPHAPFRIQPRLSPALWSWLWHFARRCNHRQMLTAAGHLKAILESSMVEYRRLVPAQPLECEWKESGLLNVLLTDRGMHAFAEEDRLISEHFGLSARRIEGSELPAFDPALKPGLAGAFYYEGDASLRPDRLNASWAARLRERGVRFLEQCEMQRIVTSGGRITTLQTLQGEMAAQFVVIATGAWSCRLARDLGCRIPVQPGKGYSVTMARPEPCPRFPMLFPEHRVAVSPFEQGYRLGSMMEFAGFDTSIRPQRIEQLRTSAEPYLVAPYTEVEHERWYGWRPMTCDSLPIIGRVPALENAYLATGHNMLGVSLAPATGRLIAEIVTGVPPHVDPAPYSANRF

SEQ ID NO: 255 - DNA, 1233 bp, Unknown
  Obtained from environmental sample
atggaattcgataccgtcgtgctcggcgcgggcattgtcggcgtgtcggtggcggtgcatcttcagaaacgcggccgtcaggtcgcactggtcgaccgcaagcagcccggcaacgaaacgtcgttcggcaatgccgggctgatccagcgtgaaggcgtctatccgtacgcgtttccgcgcgacctcggcaccttgcttcggtacgcgcgcaaccagtcgccggacgttcgctaccatgctgacgccatactcaagaccgcgccctttctttggcaatactggcgcaattctcatccggcaaaacacgcggctatcgcgaggtcgtacgcaacactgatcgagcattgcgtggacgaacaccgcgcgctggcggccgaggccggcgcgagcgcgttattgcgcccaaccggctggatcaaggtgttccgcacggcggccgtgtgggacgaagaaatccggcatgctgaacagtggcaccgggaatatggcgtcgaattcgaatcgctggatgcgggccggctgcaacagaaggagcccgatctcgacaagaccttgttaggcggcctgcgttatacggaatccgaatccgtaagcgaccccaacgcgctggtcaccgcctacgcaaagtatttcgaaacgctcggcggacgcttcttaatcggcgacgccgactcgtttcgtgaaggttggacggtcgacacgcaagacggagccatcaccgcttcgtcggcggtcgtcgcgttgggaccgtggtcggatcgtgtgagcgcgcggctcggctatcgcttgccgctcgccgtcaaacgcgggtatcacatgcactatgcgccgcagggggcagcccgtctgaatcatccggttctggacgtcgagaagggctacgtgctggcacccatggcaaaaggcatccgtttgactacgggtgcggaaatcgcgcactgcgacgcgcctaaaacacccacgcaactcgccgcggtcgaaccggttgcgcgcacgctgtttccattgggcgagcgcctcgacaacgaggcgtggatgggacggcgcccctgcacgcccgacatgatgccgatcatcggacccgccggaaatcacaaggacctgtggttcgcgttcggccatgcgcaccatgggctgacgctcggccccgtcacgggccggctgatcgccgagatgatgacccacgaggaaacgctcgtggacacgcggccgttcagggtggagcggttctaa

SEQ ID NO: 256 - protein, 410 aa, Unknown
  Obtained from environmental sample
  DOMAIN (4)...(392): FAD dependent oxidoreductase
  SITE (38)...(41): N-glycosylation site. Prosite id = PS00001
MEFDTVVLGAGIVGVSVAVHLQKRGRQVALVDRKQPGNETSFGNAGLIQREGVYPYAFPRDLGTLLRYARNQSPDVRYHADAILKTAPFLWQYWRNSHPAKHAAIARSYATLIEHCVDEHRALAAEAGASALLRPTGWIKVFRTAAVWDEEIRHAEQWHREYGVEFESLDAGRLQQKEPDLDKTLLGGLRYTESESVSDPNALVTAYAKYFETLGGRFLIGDADSFREGWTVDTQDGAITASSAVVALGPWSDRVSARLGYRLPLAVKRGYHMHYAPQGAARLNHPVLDVEKGYVLAPMAKGIRLTTGAEIAHCDAPKTPTQLAAVEPVARTLFPLGERLDNEAWMGRRPCTPDMMPIIGPAGNHKDLWFAFGHAHHGLTLGPVTGRLIAEMMTHEETLVDTRPFRVERF

SEQ ID NO: 257 - DNA, 1233 bp, Unknown
  Obtained from environmental sample
atgaaaagtgcaatcgtactcggcgccggaatggtggggatcgcgaccgcggtgcacctgcagcggcgcggctggtcggtcgtggtcgtcgaccgcagggagccggggcaggagaccagctacggcaatgccggtttcatccagagcgaggcacgccggccctatccgatgccgaccgacctgttgtcgctgctcgacatcgtcaccgggcgcagcaatgacgtgcactatcggctcgcctcgctgccgcgccacatcggcccactggtccggtactggtggaattcccttcccgcgcgacacgaccggatctcggccgactacgcacggatcatcgccaaggccgacagcgagcacggcgatctgatccgtgcctccggcgcggacaatctggtgcgccgcgacggctaccgggttctctaccgcgatcaggccgcgctggacgagggcgtggcggaggcggaagcgctgcgcgccgcgtacggcatcggctttcgcgccatgtcggccgccgaattcgccaaggccgagccgggattgatcaatcccggcgtgggcgcggtgcattggctcgagccgtggacggtctccgagcccggcgcactggtcgccgcctatgcgcatctgttcgagcgtttggggggcaccatcgtgcgcggtgatgccgaaaccctgacccagtctggcaaggggtggacggtgacgtcggctgccggccggctcgaggccgaggcggtcgtggtcgcgctcgggccatggtcgccaaaattcctgcgccgtttcggctacgggattccgatggtggaaaagcgcggctatcaccggcactatgcgggcggtcaaaagctcgatctgccgttgcgggacgccgccttcggctatgtgatggcgccgatgaccaaggggctgcgcctgaccaccggtgccgagctctctgcgcccgacgccaagccgacaccggtccagctgatgcgcgcggaggccgccgcgcgcgaactgctcgacatcggcaagcccgtggaggtcgaaccgtggctcggcacgcgtccctgcatgccggacatgctgccggtcgtcggccgcgcggcgcggcacgaggggctgtggctgcatttcggacacgggcaccaaggctttaccctcggtccgaccacggggcgcatgctcgccgaactgatgagcggcgaacagccggtcgtagacgctaccgcgtttcgccccgatcgcttctga

SEQ ID NO: 258 - protein, 410 aa, Unknown
  Obtained from environmental sample
  DOMAIN (3)...(392): FAD dependent oxidoreductase
MKSAIVLGAGMVGIATAVHLQRRGWSVVVVDRREPGQETSYGNAGFIQSEARRPYPMPTDLLSLLDIVTGRSNDVHYRLASLPRHIGPLVRYWWNSLPARHDRISADYARIIAKADSEHGDLIRASGADNLVRRDGYRVLYRDQAALDEGVAEAEALRAAYGIGFRAMSAAEFAKAEPGLINPGVGAVHWLEPWTVSEPGALVAAYAHLFERLGGTIVRGDAETLTQSGKGWTVTSAAGRLEAEAVVVALGPWSPKFLRRFGYGIPMVEKRGYHRHYAGGQKLDLPLRDAAFGYVMAPMTKGLRLTTGAELSAPDAKPTPVQLMRAEAAARELLDIGKPVEVEPWLGTRPCMPDMLPVVGRAARHEGLWLHFGHGHQGFTLGPTTGRMLAELMSGEQPVVDATAFRPDRF

SEQ ID NO: 259 - DNA, 1254 bp, Unknown
  Obtained from environmental sample
atgcacgtagtcatcctcggcagcggcgtcatcggcaccacgatggcgtactacctcgcacgcgatggtcatcgggtgacggtcatcgaccgccagcccgggccgggcctggagaccagctatgcgaatgccggcgaggtgtcgcccggctattcggcgccgtgggccggtcctggcgtgccgatcaaggcaatcaagtggatgctgatgcaccacagcccgctggtgatcaagccgatgctcgacccggccatgtggcgctggggtctgtcgatgttgcgcaactgcaccgaggcacgctatcgcctgaataagagccggatggtgcgcgtggccgaatacagccgcgactgcctgaaagcgctgcgcgccgagaccggcatccgctacgacgagcgcgcccagggcacgctgcagctcttccgcacacagaagcagctggacggcgtgggcaaggacatcgagatcctcaagcagtacggcgtgcccttccaggtgctcgaccgggcgggctatctcgaacacgagccggccctcgcgctggtcaaggaaaagttcgtcggagccctgcggctgcccggcgacgaaaccggcgactgtttcaagttcacccaggccctcgccgaacaggcgcgcgcgttgggcgtcgattttcgcttcggcaccacgattcacggcatcgacgccgccgacggcaagatccgcggcatcgacaccgacagcggccgcgtgacggctgaccattacatcgtcgcgctgggcagctactcgacccgcctgctcaagccgctcggtatcaagatcccggtatatccggtcaagggcttctcgatcaccgtgccgatctccgacgcggcacacgcgccggagtccacgatcatggacgaaacccacaaggtcgcggtcacgcgcctgggcgatcgcatccgcgtgggcggcacggcgcagctgtccggctttgacttgcaactcgacgctgggcgccgcaagacgctcgaattcgtcgtcggtgacctgttcccgcgcggcggtgacgtcgcccaggcggaattctggaccgggctgcgtccgatgacccccgacggcacgccgatcatcggcagaacgccctaccccaacctgaccctgagcaccggccacggcacgctcggctggacgatggccgccggcaccggacgcctggtcgccgaccttgtaagtggccgcacgcctgcaatccgcgtcgacgacctcgcagtcgaccgctacgcctaa

SEQ ID NO: 260 - protein, 417 aa, Unknown
  Obtained from environmental sample
  DOMAIN (2)...(398): FAD dependent oxidoreductase
  DOMAIN (2)...(351): Pyridine nucleotide-disulphide oxidoreductase
  SITE (96)...(99): N-glycosylation site. Prosite id = PS00001
  SITE (105)...(108): N-glycosylation site. Prosite id = PS00001
  SITE (378)...(381): N-glycosylation site. Prosite id = PS00001
MHVVILGSGVIGTTMAYYLARDGHRVTVIDRQPGPGLETSYANAGEVSPGYSAPWAGPGVPIKAIKWMLMHHSPLVIKPMLDPAMWRWGLSMLRNCTEARYRLNKSRMVRVAEYSRDCLKALRAETGIRYDERAQGTLQLFRTQKQLDGVGKDIEILKQYGVPFQVLDRAGYLEHEPALALVKEKFVGALRLPGDETGDCFKFTQALAEQARALGVDFRFGTTIHGIDAADGKIRGIDTDSGRVTADHYIVALGSYSTRLLKPLGIKIPVYPVKGFSITVPISDAAHAPESTIMDETHKVAVTRLGDRIRVGGTAQLSGFDLQLDAGRRKTLEFVVGDLFPRGGDVAQAEFWTGLRPMTPDGTPIIGRTPYPNLTLSTGHGTLGWTMAAGTGRLVADLVSGRTPAIRVDDLAVDRYA

SEQ ID NO: 261 - DNA, 1248 bp, Unknown
  Obtained from environmental sample
atggcagcggatgcaatcgtcctgggcgcaggcatcataggggtttcgacggcgctacaattggcgcggcgcggcaagtcggtcgtccttgtcgatcgtagggggccgggggaagagacatcctacgggaatgccgggctcatccagcgagagggcgtcgtcccttacgggttcccgcaacagttcggcctgatcctgcgctacgccttgaacaaccgtatcgatgctcactatcactggcgcgccatcccgcatgtcacttccttcctcgcgaagtactggtggcattccaacctcagccggcatcagctgatcgcacgcgcctacgctcccctgattgagcactcgatctccacccacaacgagctgatagaagaagctggtgcacaggacctcatcgccaggaatggctggactgaactcttccgcacctccgcaaagcgcgatggcgagttgaaggaagcggcacggctgcgccaggagtatggagtcactttccgggagctgacctcagccgacataaacgtagaggagcccgatatcagcggcgacttcgtcggcggcctgaagtgggaagatccgtggtccgtccgcgacccctatgcgctgaccatggcctatgttcgcctgttcgagaaactcggtgggcgggtcctcaagggtgatgcccgcagcctgtcgcagacggcgaccggctggcgcatggttgccggagaaggaaccgtcgaagcaaaggatgtggtggttgcgctcggcccctggtccgacaccgtgacgaagcccctcggctaccgcttcctcgtcggcgtcaagcgtggctatcacatgcactacggaaccagggtgggcgcaaagctcaatggctggaccatggatgcggagaagggctatttcctcgcgccgatgaaccagggtatccgcctgaccaccggagctgaattcgcgcttcgcgatgcccgcaagacaccggtccagctggagcgggcagaagcggtcgcccgcacggtcttcccgcttggcgagcgcctggacccggaaccttggatgggtgcacgcccctgcacgccggacatgatgccggtcatcggtcaggcgccgcgtcacaaaggcctctggttcgccttcggccatgcccaccacggcctgacgctcggcccggtgaccggtcaggtcatcgcggaagccattgcgggagaacagaccctcatcgacatctcggcctaccggcccgagcgcttcggggcctga

SEQ ID NO: 262 - protein, 415 aa, Unknown
  Obtained from environmental sample
  DOMAIN (4)...(395): FAD dependent oxidoreductase
  SITE (99)...(102): N-glycosylation site. Prosite id = PS00001
MAADAIVLGAGIIGVSTALQLARRGKSVVLVDRRGPGEETSYGNAGLIQREGVVPYGFPQQFGLILRYALNNRIDAHYHWRAIPHVTSFLAKYWWHSNLSRHQLIARAYAPLIEHSISTHNELIEEAGAQDLIARNGWTELFRTSAKRDGELKEAARLRQEYGVTFRELTSADINVEEPDISGDFVGGLKWEDPWSVRDPYALTMAYVRLFEKLGGRVLKGDARSLSQTATGWRMVAGEGTVEAKDVVVALGPWSDTVTKPLGYRFLVGVKRGYHMHYGTRVGAKLNGWTMDAEKGYFLAPMNQGIRLTTGAEFALRDARKTPVQLERAEAVARTVFPLGERLDPEPWMGARPCTPDMMPVIGQAPRHKGLWFAFGHAHHGLTLGPVTGQVIAEAIAGEQTLIDISAYRPERFGA

SEQ ID NO: 263 - DNA, 1254 bp, Unknown
  Obtained from environmental sample
atgagggtggtcatcgtaggaagcggggtcatcggcgtgacctcggcgtggtacctggctcgcgcgggccatgaggtcaccgtgctggaccgccagtccggtccggcgctcgaaacaagcttcgccaacgcgggggaagtatcccccggctactcgtctccctgggcaggccccggggtgccgctgaaggcgatcaagtggctcctaatgaaacacgggccgctggcgatccgcccacgtctcgaacccgcgatgtggtcttggatcctgaagatgctgtcgaactgcacctcgcagcgatacgcggtaaacaaggcacgcatggtgcccatcgcggaatacagccgcgactgccttcgcgagctgagaacgacgaccggaatcgaatacgacgaacggtcacgtggcaccctgcagctctttcgcacgcagaagcagctcgacgggatcgtcagcgacatcgaggtcctgaagcagttcggggtcgaatacacggtccttgccgcctcgggctgcgtcgccgcggaacccgcgctcgagcgcgtgagccacaagatcgtcgggggcctccggtttcctgacgacgagacaggagactgtcgagttttcacggaaaagctggcggtgctcgcgtccgccgctatcgacttccgctacggtgtcgccgtcgatggtctcgttcaggaacgcggcaaggtttcggctgtccgcacggcgaaagaggtgttcgccgccgatgcggtcgtcatcgcggcggggagctattcgccacgcttgctgaagcccatgggcgtccgcattccggtctacccggtcaagggctactcgctgacgttcccgatcgcggacgaggctgccgcgcctgtgtccacggtgatggacgagacctacaagatcgccatcacgcggcttggagaccggatccgggtgggcggcacggccgagatttccggcttcgatctctccctgccacgctcgcgccgtgcaccgctcgaacattcggttacggacctgtttccagaagccggactcgccagcgaagcctccttctggtgtggcctcaggccgatgaccccggatggccccccgatcgtgggcgccacgtcggtgcccggccttttcgtcaataccgggcatggcaccctcggatggacgatggcctgcggttccggacggatcctcgccgatatcgtgtccggaaggattccagagatcgacgtgaccgacctcggtccgggacggtaccgatcatga

SEQ ID NO: 264 - protein, 417 aa, Unknown
  Obtained from environmental sample
  DOMAIN (2)...(397): FAD dependent oxidoreductase
  SITE (96)...(99): N-glycosylation site. Prosite id = PS00001
MRVVIVGSGVIGVTSAWYLARAGHEVTVLDRQSGPALETSFANAGEVSPGYSSPWAGPGVPLKAIKWLLMKHGPLAIRPRLEPAMWSWILKMLSNCTSQRYAVNKARMVPIAEYSRDCLRELRTTTGIEYDERSRGTLQLFRTQKQLDGIVSDIEVLKQFGVEYTVLAASGCVAAEPALERVSHKIVGGLRFPDDETGDCRVFTEKLAVLASAAIDFRYGVAVDGLVQERGKVSAVRTAKEVFAADAVVIAAGSYSPRLLKPMGVRIPVYPVKGYSLTFPIADEAAAPVSTVMDETYKIAITRLGDRIRVGGTAEISGFDLSLPRSRRAPLEHSVTDLFPEAGLASEASFWCGLRPMTPDGPPIVGATSVPGLFVNTGHGTLGWTMACGSGRILADIVSGRIPEIDVTDLGPGRYRS

SEQ ID NO: 265 - DNA, 747 bp, Unknown
  Obtained from environmental sample
ccggcctcccaggtctacgtcagcaacaagcaccgcgcctgcgaacaggccggcattcgctcttttcagcaccctttgcccagcgacaccagccagcaggcgctcgagaaactgatcgatgagctcaatgccgatccaagcgtcgacggcatcctgttgcaactgccgctccctgcccacctggattcaaggccgattctcgaacgcattttaccccacaaggacgtggatggtttccacccctacaatctcggacgcctggctcagcggctgccggttctgcgcccctgcacccccaaggggatcatgaccctgctgcaggcgagcggcctcaaggtacgcggcctggacgccacggtggtgggcgcttccaatatcgtcggtcgcccgatggcattggaactgatgctcgccgggtgcaccaccacggtgtgccatcgcttcacccgtgacctggaagcgcacgtgcgccgtgccgaactgctggtcgtggcggtgggcaagccggggctggtcaagggcgaatgggttcgcgagggggccatcgtcatcgacgtggggatcaatcgcgaggaggatggacgcctggtcggcgatgtggagttcgcccctgcctcacagcgcgccgcctggattaccccggttcccggcggggtggggccgatgaccgtggcgtcattgctggaaaataccctttatgccgcggaacgccatgatgccatggagcaggagcgggtcgtcctttaa

SEQ ID NO: 266 - protein, 248 aa, Unknown
  Obtained from environmental sample
  DOMAIN (1)...(77): Tetrahydrofolate dehydrogenase/cyclohydrolase, catalytic domain
  DOMAIN (80)...(239): Tetrahydrofolate dehydrogenase/cyclohydrolase, NAD(P)-binding domain
  SITE (219)...(227): Tetrahydrofolate dehydrogenase/cyclohydrolase signature 2. Prosite id = PS00767
PASQVYVSNKHRACEQAGIRSFQHPLPSDTSQQALEKLIDELNADPSVDGILLQLPLPAHLDSRPILERILPHKDVDGFHPYNLGRLAQRLPVLRPCTPKGIMTLLQASGLKVRGLDATVVGASNIVGRPMALELMLAGCTTTVCHRFTRDLEAHVRRAELLVVAVGKPGLVKGEWVREGAIVIDVGINREEDGRLVGDVEFAPASQRAAWITPVPGGVGPMTVASLLENTLYAAERHDAMEQERVVL

SEQ ID NO: 267 - DNA, 1254 bp, Unknown
  Obtained from environmental sample
atgaagatcgcggtattgggcagtggcatcattggaacagcgacggcctggtggcttagccaggccggccacgaggtggtggtggtcgaccggcagctgcaggccggcatggaaaccagccgggccaacggcgcccagatctcggtgtcctatgcggaaccctgggccaatccgcaggttttcggcaagctgctgaagtggctggggcgcgacgatgcgcccttgtcgttcaagccgcaagccgatctccgccagtggttgtgggggctgatgttcctgagggaatgtttcccctcgcgcgtatcgcgcaatgtcagtgcgctggtcgcgatggccgaatacagccggcgaacgctacaggaaatgcggcgcgacctaggtattgcatacgatcaccaagagcgcggcatcctcaacttctaccgcagcggtgcagagttcgaacagtctcagaagctcgccgagattatgcgcgactacggcgtcgatcgccgcattgtgagcgccgatgaagtgaccaccatcgaacccgcgctggcgccttcgcgccatgccattgtgggcggcgactatacgcccgaagacgaatccggcgacgccttcctctttactcaggagctcgcgcgacgcgcagcagcagcgggcgtggagtttcgctatggcacgcaattgagccgttttattggcgtgggcgggcgtgtcgaggcagcagagttgatcgacgctaacggagagtacgagctgctccgggcggatgcctacgtcgcggcgttgggctcccatacaccggcgtatgtcacccccttgggtgtgcgttgcccggtctacccggccaagggttattccgctacgttcgatatcgtggatgccgacgcagcaccatttgtcagcctgaccgacagcgagcacaaggtggtgtatacacgcctgggatcgcgcctgcgcatggccggcacggccgagcttggcggctattcgcgcgccctgaataccgcacgttgtgagcagatgtctcgcctcgctcgcgagttgttcccaagcgccctcgattttgataatgtacgttattggtcggggttgcgacccgcgaccccctccaacgtccccctcattggtcggacccggatttccaatctttatctgaacacgggccacggtacgctcggctggaccatgggtgtcggctcaggcaaggcactggcggatctcatcagcggccaccgccccgaacccgaatttccatttctggattga

SEQ ID NO: 268 - protein, 417 aa, Unknown
  Obtained from environmental sample
  DOMAIN (2)...(403): FAD dependent oxidoreductase
  SITE (105)...(108): N-glycosylation site. Prosite id = PS00001
MKIAVLGSGIIGTATAWWLSQAGHEVVVVDRQLQAGMETSRANGAQISVSYAEPWANPQVFGKLLKWLGRDDAPLSFKPQADLRQWLWGLMFLRECFPSRVSRNVSALVAMAEYSRRTLQEMRRDLGIAYDHQERGILNFYRSGAEFEQSQKLAEIMRDYGVDRRIVSADEVTTIEPALAPSRHAIVGGDYTPEDESGDAFLFTQELARRAAAAGVEFRYGTQLSRFIGVGGRVEAAELIDANGEYELLRADAYVAALGSHTPAYVTPLGVRCPVYPAKGYSATFDIVDADAAPFVSLTDSEHKVVYTRLGSRLRMAGTAELGGYSRALNTARCEQMSRLARELFPSALDFDNVRYWSGLRPATPSNVPLIGRTRISNLYLNTGHGTLGWTMGVGSGKALADLISGHRPEPEFPFLD

SEQ ID NO: 269 - DNA, 1299 bp, Unknown
  Obtained from environmental sample
atgcgcgtactggtccttggaggtggtgtcatcggtgtctgcagcgcctactacctggcgcgcgcgggcttcgaggtggaactggtggatcgccagccgggcccggcgctggaaaccagctttgccaacgccgggcagatttcccccggctacgcctcgccctgggcggcgccgggcgtgccgctcaaggccatcagatggctgttccagcgccatgccccgctggccgtgcgcttcaccgccgaaccggcccagtacctgtggatgctgcgcatgctgcgcaactgcacggcgagccgctacgccctgaacaaggagcgcatggtgcgcctggccgagtacagccgcgactgcctggacgagctgcgcgccgagaccggcatcgcctacgagggccgccagctgggcaccacccagctgttccgcacccaggcgcagctggacgcggcggccaaggacatcgaggtgctggagcgcagcggcgtgccctacgaactgctggaccgcgccggtatcgcccgggtcgagccggcgctggcggcggtggccgaacgcctgagcggtgccctgcgcctgcccaatgaccagaccggcgactgccagctgttcaccacgcgcctggccgaactggcgcgcgggctgggcgtggaattccgcttcggcagccaggtgcagcgcttcgagctgcagcgcggacgcatcgccggcgtgtggatcgacggcaggctggtcaccgccgaccgctacgtgctggccctgggcagctacagcccgctgctgctgcgccccctgggcatccgcctgccggtctatcccctcaagggctactcgctgaccgtgccgatcgacaatccggacgccgcgccggtgtccaccgtgctggacgagacctacaaggtggccatcacccgcttcgaccagcgcatgcgcgtcggcggcatggcggagatcgccggctacgacctgcgcctgaatccgcgccggcgccagaccctggaaatggtcacccatgacctgtatcccggcgccggcgagctgtcccgggccgagttctggaccggcctgcgcccggccaccccggacggcaccccggtggtgggcgccacgcccttcgacaacctgttcctcaataccggccacggcaccctcggctggaccatggcctgcggttccggccgcctgctggccgacctgctggcgcgccagcggccgcagatccgcagcgagggactggatgtctaccgctatctgcccggcggccttcactccgctcaggccagggatgcggtgtcggcttag

SEQ ID NO: 270 - protein, 432 aa, Unknown
  Obtained from environmental sample
  DOMAIN (2)...(398): FAD dependent oxidoreductase
  SITE (96)...(99): N-glycosylation site. Prosite id = PS00001
MRVLVLGGGVIGVCSAYYLARAGFEVELVDRQPGPALETSFANAGQISPGYASPWAAPGVPLKAIRWLFQRHAPLAVRFTAEPAQYLWMLRMLRNCTASRYALNKERMVRLAEYSRDCLDELRAETGIAYEGRQLGTTQLFRTQAQLDAAAKDIEVLERSGVPYELLDRAGIARVEPALAAVAERLSGALRLPNDQTGDCQLFTTRLAELARGLGVEFRFGSQVQRFELQRGRIAGVWIDGRLVTADRYVLALGSYSPLLLRPLGIRLPVYPLKGYSLTVPIDNPDAAPVSTVLDETYKVAITRFDQRMRVGGMAEIAGYDLRLNPRRRQTLEMVTHDLYPGAGELSRAEFWTGLRPATPDGTPVVGATPFDNLFLNTGHGTLGWTMACGSGRLLADLLARQRPQIRSEGLDVYRYLPGGLHSAQARDAVSA

SEQ ID NO: 271 - DNA, 1239 bp, Unknown
  Obtained from environmental sample
gtgaagcccacctccatcctcgtcctcggtgccggcatggtcggcacttgcaccgccctgcacctggcgcagcgcggccaccacgtcaccctggtcgaccgccgcgagcccggccgcgagacctcctacggcaacgccggcatcatccagcgcgaggcggtggagccgtatgcctttccgcaggactggtccaccgtgctgcgctttgccatgaagcgcggggccgaggtcaactaccacctcggcgcgctgccggtgcaggcgccggcgctggcgcgctactggtcccactcgcggcccgaccgccatgcccgcatcgccgtggcctacggccgcctcatcgagcattgcctcgtggagcaccagcggctgatcgagctgtcgtcggccgatgacctggtcaagcgcgagggctaccgcttcgtgctgcgcgaggccgcgtcgttcgagcaggcggccgcgcgcgccgagcgcctgtcgaaggcacacgggctgcgccacgtgctgatggacggcgatgccttggcgcaggccgagcccggcctgaagcggcggctggccggcgccatccactggctggacccgtggaccgtgagcgatccgggcgcgctggtgggccgttatgcggcatcgctggagcgcgcgggcggccgcgtgctgcacggcgatgcgtccacgctgcgccagaccggcgcgctctggcaggtgcagaccgagtccggcgtggtggacgccgagcaggcggtgatcgcgctgggcccgtggtccgagggcttgctcaagccgctgggctatcgctaccccttgttcgtcaagcgcggctaccaccgccattaccgcggcggcacgggcccgcgcctgccggcctacgacctcgacagcggcctggtgctggcccccatgaagctgggcgtgcgcctcaccaccggcgccgagtttgcgctggtcgatgcgcccgcgacaccggtgcagctggggcgtgccgaggtgctggcgcgcgagttgttcgacctgcccgagccggtcgaggccgagccctggaagggcgcgcggccctgcagcgccgacatgctgccggtgatcggcgcggcgccgaagcacaagggcctgtggttcaacttcggccacgcgcaccagggcttcacgctgggcccggtgagcggccggctgatgaccgagctgatcgaaggcggcccgacggtggtggacccggcgccttatgcgccgtcgcggttctga

SEQ ID NO: 272 - protein, 412 aa, Unknown
  Obtained from environmental sample
  SIGNAL (1)...(22)
  DOMAIN (5)...(394): FAD dependent oxidoreductase
MKPTSILVLGAGMVGTCTALHLAQRGHHVTLVDRREPGRETSYGNAGIIQREAVEPYAFPQDWSTVLRFAMKRGAEVNYHLGALPVQAPALARYWSHSRPDRHARIAVAYGRLIEHCLVEHQRLIELSSADDLVKREGYRFVLREAASFEQAAARAERLSKAHGLRHVLMDGDALAQAEPGLKRRLAGAIHWLDPWTVSDPGALVGRYAASLERAGGRVLHGDASTLRQTGALWQVQTESGVVDAEQAVIALGPWSEGLLKPLGYRYPLFVKRGYHRHYRGGTGPRLPAYDLDSGLVLAPMKLGVRLTTGAEFALVDAPATPVQLGRAEVLARELFDLPEPVEAEPWKGARPCSADMLPVIGAAPKHKGLWFNFGHAHQGFTLGPVSGRLMTELIEGGPTVVDPAPYAPSRF

SEQ ID NO: 273 - DNA, 1257 bp, Unknown
  Obtained from environmental sample
atgaaccctacgcatagcgacgcgctcgtccttggcggcggcgtcatcggtctttcctgcgccctgtacttgttgaagtccggcgcctcggtccgagtgctcgagcagggcacggcgggctgcggcagctcgcacggcaactgcggaaccctgacgccgagccatgccgcgccactggcgatgccgggcatgatcggccaggcgctgcgctggatgctcaagcgcgacgcgcccctctacgtcaacccgaagcccgacctcgcgcgcctgcgctggctgctcggtttcgcgcggcgctgcaactggcgcgacttcacccgggccgccgacgcccgcgcggcgatcctgcaacgctcgcgcggcctgatcgaggaactggtgggcagcgaaggcctcgattgcgagttcgccaacggcggcgcgctgtcggtctaccgcgaccggcgcgcgatggaggccgacaactggcacgtcgaactgctcgagcgcctcggcatcggcgtggtgcgcaagaccggcgacgaagtcatgggcatggagccgaccctgctgcccggcgtcgtcggcggcatctaccatcccggcgacgcgcgcctgcgcccggaccgctacgtcgccgaactggcgcggcgcgtgcgcgagctcggcggcgtcatcgaggagggcgcgcgcatcgagggtttcgccaccggcacggccggcatcgacaaggtcgacaccagccgcggcgccttcaccggcgaccgcgtggtgctggcgctgggcgcgtggtcgccgctgctggcgcgcacgctcggcctgcacctgccgatgcagccgggcaagggctattcgatcacctggacgcggccggagctttgcccgcggctgccgctgacgctgagcgaggcctcggtctgcgtgacctcgtgggactccggcttccgcctcggcagcaccatggaattctccggctacgattcgcggctcaaccagcggcgcctgggcgcgctgcggcgcggcgcggcacgctacctgcgccagcccgaggggccggaactgcgcgaggagtggtggggctggcggccgatgagtgtcgacgaggtgccgatcatcggccccagcgcgcgctgggccaacctgatgctcgccaccggccacggcatgatgggcatgagcatgtccgccgccaccggcgaactggtggccgcgctgtgcgccggccccgcgccggcgctggacccgacgccctacgcgccgtcccgcttcggcttgtga

SEQ ID NO: 274 - protein, 418 aa, Unknown
  Obtained from environmental sample
  DOMAIN (7)...(398): FAD dependent oxidoreductase
MNPTHSDALVLGGGVIGLSCALYLLKSGASVRVLEQGTAGCGSSHGNCGTLTPSHAAPLAMPGMIGQALRWMLKRDAPLYVNPKPDLARLRWLLGFARRCNWRDFTRAADARAAILQRSRGLIEELVGSEGLDCEFANGGALSVYRDRRAMEADNWHVELLERLGIGVVRKTGDEVMGMEPTLLPGVVGGIYHPGDARLRPDRYVAELARRVRELGGVIEEGARIEGFATGTAGIDKVDTSRGAFTGDRVVLALGAWSPLLARTLGLHLPMQPGKGYSITWTRPELCPRLPLTLSEASVCVTSWDSGFRLGSTMEFSGYDSRLNQRRLGALRRGAARYLRQPEGPELREEWWGWRPMSVDEVPIIGPSARWANLMLATGHGMMGMSMSAATGELVAALCAGPAPALDPTPYAPSRFGL

SEQ ID NO: 275 - DNA, 1254 bp, Unknown
  Obtained from environmental sample
atgacggaactgaaggccgacgttctcgtgctcggcgccggcatggtcggtgtcggtgccgcactgcacctgcaacgacgcgggcgcgacgtcatcctggtcgaccggaacgagcttgcgggcgaggggacgagctacggcaatgccggcatcatcgaatgcgcctcggtcttcccctacatgtttccccgcgatgtcggggatattctttattatgcgaccaatcgcgcgccgcaggtgcgctaccgcctcgccgatctgccgtccttcctgccgttcttggtgcgctattatctcgcctccgagccgtcacgggcgttgcgcggtgcgatgggcgtgctgccgctgatccggcagagcctcgtcgagcacgaggagctgatcgcggaagccggcgtgccggagctgttgcgaagggacggctggatcaagctgttccgctctgcgaaaaccatggacaaggcgctcggcgagttcgagcgggcgaagcagtatggcgtcgcgggcgatgtcctcgatcccggagcgatcgccgcgcgcgagccgcatctgaccggcgatttcaccggcggcatccatttcacccagccgggcttcgtgcccgatcccggcggcctcgcgaaagcctatgcggcgctgttcacgcgcaagggcgggcgcttcctcgtcgcggacgcgaccacgctcgaacaggcgggtggcggctggcgcgtcagcggggcaggcggcagcgcagtggcgcgcgaagcggtcatcgcgctcggtccatggtccgatctggtgttcggcaagttcggctattccctgccgtttgcggtcaagcgcggctaccatctgcatcttgcgccgcgcggcaacgccgtgctgcagcatccggtcctcgacgccgaccagggttttgtgctggcgccgatgacccgcggcgtccgcgtcaccaccggcgtcgagttcgcccgccgcgacgcgccggagaatttcgcgcaagtcgaggccgcactgccgaaggcgcacaagctgtttccgctgggtgaggccgtcgatgcgaagccgtggcggggcgcgcggccgtgtttgcccgacatgctggctgtgatcggcaaggcgccgcggcatgcgggcctgtggttcgacttcggccaccagcatcacgggctgacgctcggccccgtcaccgggcggctgctggcggagatgatgaccggcgagacgccgttcgccgatcccgcgccgttttcgccgcagcggttcggttga

SEQ ID NO: 276 - protein, 417 aa, Unknown
  Obtained from environmental sample
  DOMAIN (7)...(398): FAD dependent oxidoreductase
MTELKADVLVLGAGMVGVGAALHLQRRGRDVILVDRNELAGEGTSYGNAGIIECASVFPYMFPRDVGDILYYATNRAPQVRYRLADLPSFLPFLVRYYLASEPSRALRGAMGVLPLIRQSLVEHEELIAEAGVPELLRRDGWIKLFRSAKTMDKALGEFERAKQYGVAGDVLDPGAIAAREPHLTGDFTGGIHFTQPGFVPDPGGLAKAYAALFTRKGGRFLVADATTLEQAGGGWRVSGAGGSAVAREAVIALGPWSDLVFGKFGYSLPFAVKRGYHLHLAPRGNAVLQHPVLDADQGFVLAPMTRGVRVTTGVEFARRDAPENFAQVEAALPKAHKLFPLGEAVDAKPWRGARPCLPDMLAVIGKAPRHAGLWFDFGHQHHGLTLGPVTGRLLAEMMTGETPFADPAPFSPQRFG

SEQ ID NO: 277 - DNA, 1254 bp, Unknown
  Obtained from environmental sample
atggcggaactgaaggccgaaattctcgtgctcggcgccggcatggtcggcgtcggtgccgcactgcacctgcagcggcgtgggcgcgacgtcatcctggtcgacaggaacgaagatgccggcgaggggacgagctacggcaatgccggcatcatcgaatgcgcctcagtcttcccctacatgtttccccgcgatatcggggatattctttattatgcgaccaaccgcgccccgcaggtgcgctatcgcctcgccgacctgccgtcgttcctgccgttcctggtgcgctattatctcgcctccgagccgtcacgggccttgcgcggcgcgatgggcgtgctgccgctgatccggcagagtcttgtcgagcacgaggcgctgatcgcagaagccggcgcgggcgagctgctccgcaaggacggctggatcaagctgttccgctctgcgaaaaccatggacaaggcgctcggcgagttcgagcgggccaagcagtatggcgtcgtcggcgatgtcatcgatcccgctgccatcgccgcgcgcgagccgcatctgaccggcgatttcaccggcggcatccatttcacgcagccgggattcgtgaccgatcccggcggattggcgaaggcctatgcggcgtcgttcaggcgcaagggcggacgtttcctcgtcgcggacgcgaccacgctcgaacaggcgggcggcggctggcgcgtcagcggagcgggcgacagcgcagtcgcgcgcgaagccgtgatcgcgctcggcccgtggtccgatctggtattcgctaggctcggctataagctgccgttctcggtcaagcgcggctaccatctgcatctcgcggcacgcggcaacgccgtgctgcagcatcccgtgctggacgccgaccagggctttgtgctggcgccgatgaaccgcggcattcgtctgaccaccggtgtcgagttcgcccgccgcgacgcgccggagaattttgcgcaggtcgaggccgcgctgccgaaggcgcacaagctgtttccgctgggagagcccgtcgacgcaaaaccgtggaggggcgcgcggccgtgcctgcccgacatgctgccggtcatcggcaaggcgcagcgccatccggggttatggttcgacttcggccatcagcatcacggcctgacgctcggcccggtgaccgggcgattgctggcggagatgatgacgggcgaggtgccgttcgccgaccccgcgccgttttcgccgcagcggtttggttga

SEQ ID NO: 278 - protein, 417 aa, Unknown
  Obtained from environmental sample
  DOMAIN (7)...(398): FAD dependent oxidoreductase
MAELKAEILVLGAGMVGVGAALHLQRRGRDVILVDRNEDAGEGTSYGNAGIIECASVFPYMFPRDIGDILYYATNRAPQVRYRLADLPSFLPFLVRYYLASEPSRALRGAMGVLPLIRQSLVEHEALIAEAGAGELLRKDGWIKLFRSAKTMDKALGEFERAKQYGVVGDVIDPAAIAAREPHLTGDFTGGIHFTQPGFVTDPGGLAKAYAASFRRKGGRFLVADATTLEQAGGGWRVSGAGDSAVAREAVIALGPWSDLVFARLGYKLPFSVKRGYHLHLAARGNAVLQHPVLDADQGFVLAPMNRGIRLTTGVEFARRDAPENFAQVEAALPKAHKLFPLGEPVDAKPWRGARPCLPDMLPVIGKAQRHPGLWFDFGHQHHGLTLGPVTGRLLAEMMTGEVPFADPAPFSPQRFG

SEQ ID NO: 279 - DNA, 1251 bp, Unknown
  Obtained from environmental sample
gtgggtgtggcacgtactgatgcaatggttcttggtgccggcattgtcggcacatcggtggcgctgcatctcgcaaaacgcggactcagtgttgccttggtcgatcgcgcggggatcggcgaacagacatcctatggcaacgccggcatcatcgaaggcaacacggtatttcctccggcgtttccttcgcattttgacgcgctcctgcgcgtcgcgcttaagcgtgccagcgaggccaactatcatttgtcattcttgccgcacgtcctgccatggttattggcgttccgcgcggcctcgcgaccggatcgccttgtggagacagcccggctgatccgccctttgttttctcatgcggttgccgagcacgaggcgctgatggccgagagcagcgccacccactacctgcgcaaaaccggctggctcaaagtttatcgtaacgagagcagttttaaggggctggcggctgagttcgacctcgcggcgaaatttggcttgccgctgaatgcactcgacactgtgggagcgcaggcgctcgagccgtcactcaattcggtatttgccaaagcggtgttctggccagaggcggcgagcatcagcagtcccctcggcgtgaccagagcctatgcgtcgcgctttgccgcgctgggaggcgtgctggtggcgggcgacgcgcgatcgctccaccggacgggtaatcgctggcgggtggacaccgcggaaggtgcgcttgatgcccaggagtgcgtggtcgcactcgggccttgggcaacggacttgcttgatgcgctcagtgtgcggttgccgctcgcagttaagcgtggctaccaccggcactttcggtcccaggggaatgcgagcctgtcgcggccggtgctcgacgccgacgtcggctatctgattaccccgatggagcaagggatgcgcataaccaccggtgcggagttcgcgccgcgcgatgcggctcccactccggtgcagtttcttcgcatcatgccgcgggcgcgtgagctttaccctttgggagagcaggtcgacgggcgaacatggttaggcagtcggccgtgctttcccgattctcggcccgtcatcgatcgggcgcccggacatgccgggctgtggctggccatcggtcacgcgcactgggggctcacactgggccccgccaccggacgcatgattgcgcagatgatggccggtgagttgccgttttgcgatcccgcgccttaccgcgcggagcgatttaactag

SEQ ID NO: 280 - protein, 416 aa, Unknown
  Obtained from environmental sample
  DOMAIN (7)...(397): FAD dependent oxidoreductase
  SITE (149)...(152): N-glycosylation site. Prosite id = PS00001
  SITE (289)...(292): N-glycosylation site. Prosite id = PS00001
MGVARTDAMVLGAGIVGTSVALHLAKRGLSVALVDRAGIGEQTSYGNAGIIEGNTVFPPAFPSHFDALLRVALKRASEANYHLSFLPHVLPWLLAFRAASRPDRLVETARLIRPLFSHAVAEHEALMAESSATHYLRKTGWLKVYRNESSFKGLAAEFDLAAKFGLPLNALDTVGAQALEPSLNSVFAKAVFWPEAASISSPLGVTRAYASRFAALGGVLVAGDARSLHRTGNRWRVDTAEGALDAQECVVALGPWATDLLDALSVRLPLAVKRGYHRHFRSQGNASLSRPVLDADVGYLITPMEQGMRITTGAEFAPRDAAPTPVQFLRIMPRARELYPLGEQVDGRTWLGSRPCFPDSRPVIDRAPGHAGLWLAIGHAHWGLTLGPATGRMIAQMMAGELPFCDPAPYRAERFN

SEQ ID NO: 281 - DNA, 1242 bp, Unknown
  Obtained from environmental sample
atgaaattcgacatcatcgttgccggcgcaggcgtcatcggcgtgtgcgttgcggtccatctgcagaagcggggccgttccgtgctgctggtggaccggcgcgagcccggtttcgagacctcgttcggcaatgccgggttgatccagcgcgagggcgtctatccgtatggatttccgcgcggcgtgagcgtgctcctgcgccatgggctcaaccgcggggtcgacgtgcacatccacccgctggcgctgccgcggatcgcgctgttcctgtggaaatactggcgccattcgcggcccgcccgacaccgggagatcgcgcgcgcttatgccaagctcatcgagcgttgcgtcgacgagcacgacgcgctggtggccgaggccggggcggagcacctgatccgccgcgacggctggctgaagctgttccgcaccgaacaggagcgcgatctgcgcttcgccgaagccgagcgttggcgtggcgagttcggcgtgcagtatcggatgctcgaccgcgccgacgtggcgcgcgaggagccgttcctcgcggcggggctcgtcggcgcgctgcactggacgcagccgacccgcacgcccgaccccaacggcctggtctcggcctatgcggcgctgttcaagtcgctcggcggggttttcctgcagggcgatgccaggacgctcgcggccaacggcagcggctggagcctcacgaccaacaagggtccggcacaggccgcaggcgcagtgatcgcgctcgggccgtgggcggacacggtgacgctcgggctcggctacagtctgccgctcgcggtgaagcgtggctatcacatgcattaccgcgccgccggcgaggcgaagctcaatcatccggtgctcgaccacgagcgcggctatctcatcgcaccgatggcgcgcggcatccgcctgacgaccggcgccgagttcgccatgcgcgattccgtgcgcacgccggtgcaactcgatcgggcggagccgattgcccgcgacctgttccccctggccgagcggtttgatgcgcagccgtggatgggagcgcgaccgtgcacgcccgacatgatgccgatcatcggccccgctccgaaacatcggaacctgtggttcgccttcggccatgcccaccacggcctgacgctgggcgccgtcaccggccgcctggtcgccgagatggtcaccggcgaagcgcccgtggtcgacccgagcccttatcgcgccgaccgattctga

SEQ ID NO: 282 - protein, 413 aa, Unknown
  Obtained from environmental sample
  DOMAIN (4)...(395): FAD dependent oxidoreductase
  SITE (232)...(235): N-glycosylation site. Prosite id = PS00001
MKFDIIVAGAGVIGVCVAVHLQKRGRSVLLVDRREPGFETSFGNAGLIQREGVYPYGFPRGVSVLLRHGLNRGVDVHIHPLALPRIALFLWKYWRHSRPARHREIARAYAKLIERCVDEHDALVAEAGAEHLIRRDGWLKLFRTEQERDLRFAEAERWRGEFGVQYRMLDRADVAREEPFLAAGLVGALHWTQPTRTPDPNGLVSAYAALFKSLGGVFLQGDARTLAANGSGWSLTTNKGPAQAAGAVIALGPWADTVTLGLGYSLPLAVKRGYHMHYRAAGEAKLNHPVLDHERGYLIAPMARGIRLTTGAEFAMRDSVRTPVQLDRAEPIARDLFPLAERFDAQPWMGARPCTPDMMPIIGPAPKHRNLWFAFGHAHHGLTLGAVTGRLVAEMVTGEAPVVDPSPYRADRF

SEQ ID NO: 283 - DNA, 1263 bp, Unknown
  Obtained from environmental sample
atgaaagccatcgttctgggcagcggcgtgctgggcaccaccaccgcctattacctggccaagcagggccatgaggtcgtggtgatcgaccgccaggaaggtccggcgctggagaccagcttcgccaatgccggcgaggtctcgcccggctattcggccccctgggcggctcccggcgtgccggtcaaggcggtgaagtggatgttcatgaagcatgcgccgctgatcctgcgcccccatatggacccgttccagtggcgctggatggccaagatgctgctgaactgcaattccaagagctatgccgtcaataagggccgcatggtgcgtctggcggaatattcccgcgatatgctgcgcgatctgcgcgccgatatcggcatttcctatgacgagcgcaccaaaggaacgctacagctgttccgcaagcagcagcaggtcgatgcctcggctgccgatatggcggtgctggaccagtatggcgtgccttacgaagcgctggatgtcgaaggctgcgtgcgctatgagccgggcctgcgctattcgcaggacaagatcgtcggcggcctgctgctgcccggcgacgagaccggcgactgcttcaagttcaccaatgccctggccgagaaggccaaggaactgggcgtgcagttccgcttcggcaccactatcaacagcatcatccgcaccggcagcaaggtgaccggcgtgcagaccagcgccggcgaattctccggggatgccgtggtggtggcgctgggcagctattcccgcttcctgctggagccgctgggcttcaccgtgccggtctatccggtcaagggctattccatcaccttgccgatcacccaggaagacgccgctccggtctcgaccgttctggacgaaacccacaaggtcgccatcacccgtctgggcgaccgcatccgcgtggctggcatggccgagctgaacggctataatatggacctgccgcagagccgccgcgataccgtcgaatatgtggtttcggacctgtatcccaagggcggcgatgtctcgaagtcggaattctggtgcggcctgcgcccgatgacccccgacggcactccgatcctgggccccacggcctatcagggcctgtatctgaacaccggccatggtaccctgggctggaccatggcctgcggttcgggccgcgtgctggccgatgtcatctcgggtcgcaaaaccgatatcgacatgggcggtttgaccctggatcgctacggcaacgccgcttaa

SEQ ID NO: 284 - protein, 420 aa, Unknown
  Obtained from environmental sample
  SIGNAL (1)...(20)
  DOMAIN (2)...(398): FAD dependent oxidoreductase
MKAIVLGSGVLGTTTAYYLAKQGHEVVVIDRQEGPALETSFANAGEVSPGYSAPWAAPGVPVKAVKWMFMKHAPLILRPHMDPFQWRWMAKMLLNCNSKSYAVNKGRMVRLAEYSRDMLRDLRADIGISYDERTKGTLQLFRKQQQVDASAADMAVLDQYGVPYEALDVEGCVRYEPGLRYSQDKIVGGLLLPGDETGDCFKFTNALAEKAKELGVQFRFGTTINSIIRTGSKVTGVQTSAGEFSGDAVVVALGSYSRFLLEPLGFTVPVYPVKGYSITLPITQEDAAPVSTVLDETHKVAITRLGDRIRVAGMAELNGYNMDLPQSRRDTVEYVVSDLYPKGGDVSKSEFWCGLRPMTPDGTPILGPTAYQGLYLNTGHGTLGWTMACGSGRVLADVISGRKTDIDMGGLTLDRYGNAA

SEQ ID NO: 285 - DNA, 1263 bp, Unknown
  Obtained from environmental sample
atggccagacctcgttcagtcatcatttgcggcggcggcatcatcggcctctgcaccgcgtattcactcgcccgcgagggtttccgcgtgaccctgctcgagcgcaacgccgagggtgctgactcctgcgcgcacggcagcgccggctacgtgtcgccgagccacgtcgcgccgatctccgcgccgggcatggtgctgaagggcctgaaatggatgatgagctcgcgcagcccgttctacatcaagccgcggctcgacacggagctcatgcgctggggatggctgttcgcccgcgcgtgcacggcgaaacacatgcgacgctccgcgcccgtgctgcgcgacctctgcctcggcggtcgcgagctgttcgtcgagctggcggatatcacgggcaacagtttcgaactgaagaccgagggattgctgaatctctgcaagacgcccgaaggtctcgaccacgaggcacacggactcgccgtgctggccaacgaggtgggcgtggaggcgcgcgtgctcgatgggaagcagaccgcggcacttgagccgggcatcaagatggaggtggccgggtcggtctattttccgattgatgcgcacctgacgccgcggaagttcatgccggcactcgtggcgctgctgaaggaaatgggcgtgaagttccattggaacacgagcgtctacggttggcgttccgaagcggggcgcatcgccggcgtccagacgaccgcgggcgacctggtggccgacgactatgtgctcgccggtggttcgtggtcgccgtcgatggtggccgggttgagcatccgcatcccgatgcaggcgggcaagggctacagcctgacgatcgagaaaccccgcttccgtctgaccaagtcgcttatcctgaccgaacgccgggtggcggtgacaccgatgggcgaccagttgcgttttggtggcaccatggaaatcgccggccacagcgacaacgtgcgccaggagcgcatcgaacagatcattgccgcggcgccgcactatttccccgagttcacgccgcgggacttcgcgggcatcaagccgtggttcggttaccggccggtcacgcccgatggcttgccgtacattggacgtttccgccgccaccagaacctcgtcgcggcgtgcggccacgcgatgcttggcgtcacgatggcgccgattaccggccgtctcgtgggcgaggtgctcacgggcaggaaaccgagcgtggacctgagcctgttgaatccggacaggtacgcgtag

SEQ ID NO: 286 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
MARPRSVIICGGGIIGLCTAYSLAREGFRVTLLERNAEGADSCAHGSAGYVSPSHVAPISAPGMVLKGLKWMMSSRSPFYIKPRLDTELMRWGWLFARACTAKHMRRSAPVLRDLCLGGRELFVELADITGNSFELKTEGLLNLCKTPEGLDHEAHGLAVLANEVGVEARVLDGKQTAALEPGIKMEVAGSVYFPIDAHLTPRKFMPALVALLKEMGVKFHWNTSVYGWRSEAGRIAGVQTTAGDLVADDYVLAGGSWSPSMVAGLSIRIPMQAGKGYSLTIEKPRFRLTKSLILTERRVAVTPMGDQLRFGGTMEIAGHSDNVRQERIEQIIAAAPHYFPEFTPRDFAGIKPWFGYRPVTPDGLPYIGRFRRHQNLVAACGHAMLGVTMAPITGRLVGEVLTGRKPSVDLSLLNPDRYA

SEQ ID NO: 287 - DNA, 1257 bp, Unknown
  Obtained from environmental sample
atgagccaaggaagcgtggtcattattggtgccggaataatcggtgcctggtccgcgtattttctcagtcgatcaggctggcaggtgacgatactggatcaaggcggcttcggaaaaggctgttcgcatggcaattgcggttatgtttcgcccagccatgtgctacccattcctggaccgaagaccatccgcacagccatccgggcactgctccaaccgaacggaccattcaagatccgcttccgcttcgatcctgccttatggagctggatgtatcgctttctgcgtcgctgcaactaccacgacatgattcaggcgggccatgccctgaacccgctcttacaatcctcacgcgagttgttcgagcagataatccgggacgagaaactggactgcgaatggcaggcccgtgggttgatcctcgtttttcgcacgacgaaaggcatggaggaatatgcggaaaccgacaagctgctgagcgatacgtacggcgtgccggcaaagcggcttgacgaggacgaattgacagcgtttgagccggccctcaaacccggactgggcggtggctggttgtacgacatggatgcacacctcaggcctgaccgcttcatggccgaaatgcggcgcgtcctctctgaacgaggggtgaccattctcgaagggaagactttccgtgagttccgtcgggctggccgacaggccgaggcggcggtcacggaccacggcgaactgcgagccgatgcgtttgtcattgccaccggggcttggacgccgcgattccgcaatcaacttggttgtgtcataccgattgaaccgggcaagggctattcaatcacgatgggcaaacccagccgctgtccccaagtgcccctcatcttcgaggaacaccgcgtggctgtcacgcccatggtcagcgcgtacaggctcggttccacaatggaatttgccggttacgacgcgacattgcggcgtgatcgcttggaccttctcaagctcggggccgcaacgtacctccaggagcctgtcggcgagccgattaccgaagagtggttcggctggcgtccgatgacgccggacggcgtgccgatgattggcccgtcacctcggctcggaaacgtgttgatcgcagctgggcacaatatgatcggcctggccactggctccggcaccggccggctcgttgcagaactgcttaccgggcaacctccacacctcgatccccaaccctataatcccgcacgcttcgggacgctttga

SEQ ID NO: 288 - protein, 418 aa, Unknown
  Obtained from environmental sample
  DOMAIN (5)...(397): FAD dependent oxidoreductase
MSQGSVVIIGAGIIGAWSAYFLSRSGWQVTILDQGGFGKGCSHGNCGYVSPSHVLPIPGPKTIRTAIRALLQPNGPFKIRFRFDPALWSWMYRFLRRCNYHDMIQAGHALNPLLQSSRELFEQIIRDEKLDCEWQARGLILVFRTTKGMEEYAETDKLLSDTYGVPAKRLDEDELTAFEPALKPGLGGGWLYDMDAHLRPDRFMAEMRRVLSERGVTILEGKTFREFRRAGRQAEAAVTDHGELRADAFVIATGAWTPRFRNQLGCVIPIEPGKGYSITMGKPSRCPQVPLIFEEHRVAVTPMVSAYRLGSTMEFAGYDATLRRDRLDLLKLGAATYLQEPVGEPITEEWFGWRPMTPDGVPMIGPSPRLGNVLIAAGHNMIGLATGSGTGRLVAELLTGQPPHLDPQPYNPARFGTL

SEQ ID NO: 289 - DNA, 1284 bp, Unknown
  Obtained from environmental sample
atggcgaccgaaacggagcaatcagcggaatccatgccagacacagacatccttgtactcggcgccggcattgtcggcacctccgtcgcgctgcatctcgctcagcgaggcctgaaggtaaccctggttgatcggcaggggccggggaaggggacctcgtacggcaatgccgggatcatcgaaggcaacacggtgttcccgccggcatttccgtcggatttcggcacgctgctgaaggtcgtgttcaggcgctcgacgatcgccagctatcatctctccttcctgccgcaggtcgcgccctggctgatggcattccgcgcggcgtcgcagcccaagcagctggtcgagaccgcgcatctgatgcggccgctgtttgcccgcgccgtggccgagcacgaggagttggtgctggcctcgggcgccgggcggcacttgcgcaagaccggctggttgaagctctaccgcagcgacgcctcgatcgcagcgctcaagccggaattcgatctcgctgcgtcgttcgggctttcactcagtccgctcgacatccagggcgcgttggagctggagccgtcgctcgcgccggtgttccgccatgccgtgttctggccaggcgccgccagcatcgacaatccgctggccttgaccgaggcctatgcggcgcgctttgccgcgctcggcggcgtgaccgtcaaaggcgaagcacgctcgctgcgccgggaaggacacatttggcgggtcgaaaccgccgatggtccggccgttgcggagcaggcggtggcggcgctcggcccctgggcgcctgacgtattggagcctctcggcatcaggctgccgctcggcgtaaagcgcggctatcaccgccacttcagggcgcagggcaatgcggctttgacgcgtccggtgctcgacgccgatgtcggctattgcctggcgccgatgcagcaggggatccggcttaccaccggcgccgaattcgccgcgcgcgacgcgccgccgacgccggcgcagctcgcttcggtgctcccctatgcgaaagcgctgtttccgctcggcgagtcagtcgaggcgcagccgtggatggggtcacgcccctgcttcccggattcgcgtccggtgatcggcaaggctgcgggccagccgggactgtggctcgccatcggccacgcgcattgggggctgacgctcggccccgtcaccggccggctgatcgccgaaatggtcaccggcgcgacgccgttctgcgatcccgccccgtatcgcgcggagcggttcctcgggtcctaa

SEQ ID NO: 290 - protein, 427 aa, Unknown
  Obtained from environmental sample
  DOMAIN (16)...(406): FAD dependent oxidoreductase
MATETEQSAESMPDTDILVLGAGIVGTSVALHLAQRGLKVTLVDRQGPGKGTSYGNAGIIEGNTVFPPAFPSDFGTLLKVVFRRSTIASYHLSFLPQVAPWLMAFRAASQPKQLVETAHLMRPLFARAVAEHEELVLASGAGRHLRKTGWLKLYRSDASIAALKPEFDLAASFGLSLSPLDIQGALELEPSLAPVFRHAVFWPGAASIDNPLALTEAYAARFAALGGVTVKGEARSLRREGHIWRVETADGPAVAEQAVAALGPWAPDVLEPLGIRLPLGVKRGYHRHFRAQGNAALTRPVLDADVGYCLAPMQQGIRLTTGAEFAARDAPPTPAQLASVLPYAKALFPLGESVEAQPWMGSRPCFPDSRPVIGKAAGQPGLWLAIGHAHWGLTLGPVTGRLIAEMVTGATPFCDPAPYRAERFLGS

SEQ ID NO: 291 - DNA, 1263 bp, Unknown
  Obtained from environmental sample
gtgagccatgttgcggtcatcggcggtggcgtggtcggcgtcgcgtgcgcgtactatctatcgcgcggcggctggcaggtcacgctcgtcgatcggggccgcatcgggggcggctgctcgcatgccaattgcgggttcgtttcgcctagccatgtgctgccgttggccgagccgggagcgatccgccgcgtcctgcgtgcgatgctgaagaaggactccccgttctacatcaagccgcgccccgatccggcgctgtggggatggctgatgcgcttcgcgcggcgctgcaacatgaccgatatgcttgccggggggcgcgcctgtcatgcgctgctcgaatcgtcgcgcgtgctgtacccggcgctccttagcgaggagcaaatcgattgcgagtgggagccgcgggggctgttgttcgtctgccagacgcggccggcgctggatcactttgccgccaccgatgcgctgttggccaggcatttcaatctgccggcgcggcggatcgatggcgaagagctcgccgagttcgagccggcgcttttgccggggatggccggcggatacttttacgaagaggactcgcatttgcgccccgaccgattgatggcggagtggcggcgcgtattggagcggcgcggcgttcgcgtgatcgagaactgtgaatttcgcggctttgtggcgcacgatggcgccaccgcctcgaacggcgccgctcgtcgggcgaaaacgtcgctcgatgaaatccaggccgacgcgttcgtggtcgccaccggcgcctggacgccgcttttggcaagtgaaatcggctgccgagtgccgatccagcccggcaagggttactcgatgaccatgccgcgaccggccgtctgcccgcgagtgccgatgatcctggtcgagcatcgcgtggcggtcactccgatgcgctcgggctaccggcttggttcgacgatggagtttgcgggctacgacacgtcgctgcggccagcgcggctggagctgttgcggcgtggcgccgccgcctgcctgcgcgagccgtactgtgaaccggtgcaggaaacttggtacggctggcggcccatgacctacgacagcgtgcccgtgatcgaccgcagtccgaaatggcacaacgtgtttatcgccgcgggccacaacatgcttggactgtcgatggcgacgggcaccggcaagctcgtggcggaattggtcagcggtcgcgagccgcatattgacccggcggcttatagcatggggcggttcgggtga

SEQ ID NO: 292 - protein, 420 aa, Unknown
  Obtained from environmental sample
  DOMAIN (3)...(401): FAD dependent oxidoreductase
  SITE (98)...(101): N-glycosylation site. Prosite id = PS00001
MSHVAVIGGGVVGVACAYYLSRGGWQVTLVDRGRIGGGCSHANCGFVSPSHVLPLAEPGAIRRVLRAMLKKDSPFYIKPRPDPALWGWLMRFARRCNMTDMLAGGRACHALLESSRVLYPALLSEEQIDCEWEPRGLLFVCQTRPALDHFAATDALLARHFNLPARRIDGEELAEFEPALLPGMAGGYFYEEDSHLRPDRLMAEWRRVLERRGVRVIENCEFRGFVAHDGATASNGAARRAKTSLDEIQADAFVVATGAWTPLLASEIGCRVPIQPGKGYSMTMPRPAVCPRVPMILVEHRVAVTPMRSGYRLGSTMEFAGYDTSLRPARLELLRRGAAACLREPYCEPVQETWYGWRPMTYDSVPVIDRSPKWHNVFIAAGHNMLGLSMATGTGKLVAELVSGREPHIDPAAYSMGRFG

SEQ ID NO: 293 - DNA, 1245 bp, Unknown
  Obtained from environmental sample
atgcattgccagaccatcgtcctgggcgccggcatcgtcggcgtcagcaccgccctgcacctgcaggcccgcgggcgccaggtgatcctcgtcgaccgcgacgaaccgggcagcggcaccagccatggcaacgccgggctgatcgagcgctccagcgtgatcccctacgccttcccgcgccagtggagtgccttgctgcgctacggcctgaaccgccagcccgacgtgcgctacagcctgacccacctgcccaaggccgcgccctggctgctcagctattggcgccagtccgcccccgggcaactggccaaggccgccgccgacatgctgccgctggtgcaacgcagcgtcgaggaacacgatgtgctgatcgaagccgccggcctgcaaggactggtacaggccaagggctggatcgaggtgtaccgtgatgccgcgctgttcgaacaggccaagcgcgacctgaaggggctggcccgctacggcctgcagtacgaaatcctcgaacgcgaacagttgcaggcccgcgaacagcaactggacggtggcgtgatcggcggcatccactggctcgacccgaagacggtgagcaacccgggcggcctgacccgtggctacgccgcgctgttcgtccagcgtggtgggcagttcctccatggcgacgcgcgcagcctgcgccaggtcgagggcggctggcagctggacacgcgtcgcggcagcgtcaccgccgacgaagtggtggcctgcctcggcccgcagtcggccgacctctacgagcggctgggctaccgctttccgctgggcatcaagcgcggctaccacatgcactacgccacccgcgagggtgccgagctgggtcattcgatttgcgacacccagggcggttacgtcctggcgccgatggcccgtggtgtgcgcctgaccaccggcatcgagttcgcggcgagcgacgccgccgccaacgagatccagctacgccgctgcgaggcactggcacgccagctgttcccggccctgggcgagcgcctggacgacaagccctggctgggccgccgtccctgcctgccagacatgcgcccggtgatcggcccggcgcccctgcacaagcacctgtggttcaacttcggccatgcccaccacggcctgaccctgggcccggtcagcggccgcctgctggcggagctgatgaccggcgagcgccccttcaccgaccctgcgccctacagcgccgcacgtttcgactga

SEQ ID NO: 294 - protein, 414 aa, Unknown
  Obtained from environmental sample
  DOMAIN (4)...(395): FAD dependent oxidoreductase
MHCQTIVLGAGIVGVSTALHLQARGRQVILVDRDEPGSGTSHGNAGLIERSSVIPYAFPRQWSALLRYGLNRQPDVRYSLTHLPKAAPWLLSYWRQSAPGQLAKAAADMLPLVQRSVEEHDVLIEAAGLQGLVQAKGWIEVYRDAALFEQAKRDLKGLARYGLQYEILEREQLQAREQQLDGGVIGGIHWLDPKTVSNPGGLTRGYAALFVQRGGQFLHGDARSLRQVEGGWQLDTRRGSVTADEVVACLGPQSADLYERLGYRFPLGIKRGYHMHYATREGAELGHSICDTQGGYVLAPMARGVRLTTGIEFAASDAAANEIQLRRCEALARQLFPALGERLDDKPWLGRRPCLPDMRPVIGPAPLHKHLWFNFGHAHHGLTLGPVSGRLLAELMTGERPFTDPAPYSAARFD

SEQ ID NO: 295 - DNA, 1296 bp, Unknown
  Obtained from environmental sample
atgcacatcattgtcatcggcggcggcgtcatcggcctgagcgccgcctggtttttgcgagaagaaggttgtgaggtaacggtgttggaaaaaggcgacctcacagacaactgttcttttgggaatatgggctacctgtcgccttcgcacttcgtaaccttagcctcgcccggtgtggtagaacagggcctgctgtggctgctgaatgcggaaagccctttctacattcggcccagcctgagctggtcgttagtggactggggtcttaagttcatgcgcgcttctacgcgggcacacgtggagcgttctgcacggccactggccgacttgctgctgctgtcaaaagcagagacgaaacggtggatagacgccggcctgcttcaggtagagtacaccgagcgcggttgcattatgtactacaacactcctaagggcgaacgcggtgaaatagaaacggctcgaaaggctgaagaactgggcttgaaggtaacagtgctcgaccgcgaccaagcgcgcactttggagcctgacgcccagctcgaagtacgcggaggagtgctgtaccacgacgatgcacacctttatcctaatgcactcatggagcagctgccgcgcttgttggaaagccgaggtgttcgcattcagcgaaatgcggaagtagtggcctttgagcgcgttaacggcgcaattgctgccgtgcgctgctgctccacaaccgaaacaggccgtgaaaacccagaacatctggaggccgacgcggtagtcctggcagcaggctcctggtcgccactgctggcacgcctgtgtggcgaatacttgccgctgatgcctggcaaaggctactccattacggtggacaatccagagcgcactctccatcacccttgcatcctcaaggaagctaaagtggccctgacgccctggagccatcggctccgcatcggcagcaccatggaaataggtcacatggatggccgcatccgattgcggcgcgtgcagggcatcttacgggcagtgcgccaatacatgcctggcattgccaatgacccaggagtccgtgcccttgaggacgcaactactttgcaacggcgcacgtggtttggctatcgccccctatcggctgatggcatgccctacattggctttgcccgaaaaaatcgcaatctaattatcgccacggggcattccatgttgggcgtgagcttggctgctggaacgggcaagctcgtagcagagttggtctgcgggaaaccaacatctctgcctgtagagcctttcgacccgaagcgcttttga

SEQ ID NO: 296 - protein, 431 aa, Unknown
  Obtained from environmental sample
  DOMAIN (2)...(413): FAD dependent oxidoreductase
  SITE (37)...(40): N-glycosylation site. Prosite id = PS00001
MHIIVIGGGVIGLSAAWFLREEGCEVTVLEKGDLTDNCSFGNMGYLSPSHFVTLASPGVVEQGLLWLLNAESPFYIRPSLSWSLVDWGLKFMRASTRAHVERSARPLADLLLLSKAETKRWIDAGLLQVEYTERGCIMYYNTPKGERGEIETARKAEELGLKVTVLDRDQARTLEPDAQLEVRGGVLYHDDAHLYPNALMEQLPRLLESRGVRIQRNAEVVAFERVNGAIAAVRCCSTTETGRENPEHLEADAVVLAAGSWSPLLARLCGEYLPLMPGKGYSITVDNPERTLHHPCILKEAKVALTPWSHRLRIGSTMEIGHMDGRIRLRRVQGILRAVRQYMPGIANDPGVRALEDATTLQRRTWFGYRPLSADGMPYIGFARKNRNLIIATGHSMLGVSLAAGTGKLVAELVCGKPTSLPVEPFDPKRF

SEQ ID NO: 297 - DNA, 1242 bp, Unknown
  Obtained from environmental sample
atgcagtctattgcagttatcggcggtggaatcaccggcgtcacttccgcttatgcccttgctaagcgtggttatcaagttaccctttttgaaaagcagcgctatgcagcgatggaaacctcttttgccaatggtggtcagctatcggcctctaatgcagaggtttggacctgctggtcgactattctcaaaggattaaagtggatgctaaaaaacgatgcgccactgctcgtaaatcccaagccatcttggcataagttcagttggtttgctgaatttatcgcttcaatacctcagtatgaaaacaatacgaccgagacggcacgtatggcgattgcagcgcgtgagttattgtttggctgggctaaagaagaaaatatcgatttcgatcatgtcgagaagggaatactgcatatttatcgtgataaagctggttttgaacacgctcaaaaagtctcccaattgcttgctaaaggtggtttggtgcgcgaaacgctttctccaagtgacattcagcgaatcgagcctacgctaaaagggagttactacggtggctttttaacacccagtgataccaccggtgatatccataaatacacccaaggtttagccagagcctgtgagcgtttgggtgttaactgtctgtatgagcaagaagtgttggaagttaaggctgatgatcgtgaagctagggtaattgttaagtcagtagaaggctcgattagccatcaattcgatgcgcttgtggtatccgctggtgtggccagtcggaaactagcggcgtcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtactgcagagtttaacggctacaacaaagatatcagggctgatcgtattaagcctttggtggactgggtgaatcaatgcttcccagatgtaaacacacgaagcgtagttccttgggcgggacttcgtcctatgatgcctaatatgatgccaaaagtgggtaagggtaaattacccaccgtattctacaataccggtcatggccatttgggttggacgttaagtgcggtgacggctgatatgttagcggatgtgatcgatcaggctagcacctcggcacaatttgttcccgcttga

SEQ ID NO: 298 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTILKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLARACERLGVNCLYEQEVLEVKADDREARVIVKSVEGSISHQFDALVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 299 - DNA, 1242 bp, Unknown
  Obtained from environmental sample
atgcagtctattgcagtcatcggcggtggaatcaccggcgtcacttccgcttatgcccttgctaagcgtggttatcaagttaccctttttgaaaagcagcgctatgcagcgatggaaacctcttttgccaatggtggtcagctatcggcctctaatgcagaagtttggacctgctggtcgactattcacaaaggattaaagtggatgctaaaaaacgatgcgccgctgctcgtaaatcctaagccatcttggcataagttcagttggtttgctgaatttatcgcttctatacctcagtatgaaaacaatacgaccgagacagcgcgtatggcgattgccgcgcgtgagttattgtttggctgggctaaagaagaaaatatcgatttcgatcatgtcgagaaaggaatattgcatatttatcgtgataaagctggctttgagcatgctcaaaaagtttctcaattgctagctaaaggtggtttggtgcgcgaaacgctttctccaagtgacattcagcgaatcgagcctacgcttaaagggagttactacggtggctttttaacacccagtgatactaccggtgatatccataaatacacccaaggcttagccaaagcctgtgagcgtttgggtgttaactgtctgtatgagcaagaagtgttggaagttaaggctgatgatcgtgaagctagggtaattgttaagtcagtagaaggctcgattagccatcaattcgatgcggttgtggtatccgctggtgtggccagtcggaaactagcggcatcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtaccgcagaatttaacggctacaacaaagatatcagggctgatcgtattaagcctttggtggactgggtgaatcaatgcttcccagatgtaaacacacgaagcgtggttccttgggcaggacttcgtcctatgatgcctaatatgatgccaaaagtgggtaagggtaaattacccaccgtgttctacaataccggtcatggccatttgggttggacgttaagtgcggtgacggctgatatgttagcggatgtgatcgatcaggctagcacctcggcacaatttgttcccgcttga

SEQ ID NO: 300 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTIHKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLAKACERLGVNCLYEQEVLEVKADDREARVIVKSVEGSISHQFDAVVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 301 - DNA, 1254 bp, Unknown
  Obtained from environmental sample
atgtccaaggttaccctcgtgctcggcgccggcattatcggcgtttccacagccatccatctcgcccgtcgagggcgctcggtggtgctggtggatcgccggggcgccggcgaggaaacctccttcggtaatgccggcctgatccagcgcgagggcgttgtgccctacggcttcccgcaggagctcgggatgctgatccgttatggcttcaacaaccggatcgacgcccattaccatgcaagcgcgatgctgaagctcgtgccgttcctgtcgcgctactggtggcattcgaacaagagccggcatcaggtcatcgcacgcgcctatgcacccttgatcgaaaactcgatcagcgagcatcaggacctgatccaggcggcgaatgccgaccatctgatccgcaaggacggctggatggagatcttccgcacggccggcaaacgcgacacggagctcgccgaggcagaacgactggcgcgtgaatacggtgtcagttaccgggcactcaaccgcgaagaactggccaaggaagagccgcatatccgcggcgatttcgtcgggggcctcaagtggaatgacccgtggtcggtgaccaatccgcatggcctgaccatggcttacctcagctacttccagtcgctcggcggacgcttcgtcaagggcgacgccacgacgctggaaacgggcgcatccggcaagggctggcgcgtgaagacggatgacggcatggtcgatggcgacgatgtggtgctggcactcggcccatggtcggaggaggtcacccgcaaattcggctaccgtttcctgctcggcgtcaagcgcggctaccacatgcattatgcgcccgaagctaatgcggtcctcaacaactggacgatggatgccgagcgcggttacttcctcgcgccgatggaaaagggcatccgcctgacgacgggtgcggaatttgccaagcgcgatgcgccgaagtccccggttcaactggcgcgcgccgaaaaggtggctcgagagatcttcccgctggctgagcggctggatgccgagccctggatgggtgcccgcccctgcacgccggacatgatgccggtcatcggcaaggcaccgcgccatcagggcatgtggttcgccttcggccatgcgcatcatggcctcacactcggcccggtgaccggccgcttgatcgcggaaatgatggacggggaagagacgttcatcgacgccaaggcctggggccctgaacgttttcgcccctga

SEQ ID NO: 302 - protein, 417 aa, Unknown
  Obtained from environmental sample
  DOMAIN (4)...(397): FAD dependent oxidoreductase
  SITE (80)...(90): Zinc carboxypeptidases, zinc-binding region 2 signature. Prosite id = PS00133
  SITE (99)...(102): N-glycosylation site. Prosite id = PS00001
  SITE (294)...(297): N-glycosylation site. Prosite id = PS00001
MSKVTLVLGAGIIGVSTAIHLARRGRSVVLVDRRGAGEETSFGNAGLIQREGVVPYGFPQELGMLIRYGFNNRIDAHYHASAMLKLVPFLSRYWWHSNKSRHQVIARAYAPLIENSISEHQDLIQAANADHLIRKDGWMEIFRTAGKRDTELAEAERLAREYGVSYRALNREELAKEEPHIRGDFVGGLKWNDPWSVTNPHGLTMAYLSYFQSLGGRFVKGDATTLETGASGKGWRVKTDDGMVDGDDVVLALGPWSEEVTRKFGYRFLLGVKRGYHMHYAPEANAVLNNWTMDAERGYFLAPMEKGIRLTTGAEFAKRDAPKSPVQLARAEKVAREIFPLAERLDAEPWMGARPCTPDMMPVIGKAPRHQGMWFAFGHAHHGLTLGPVTGRLIAEMMDGEETFIDAKAWGPERFRP

SEQ ID NO: 303 - DNA, 1269 bp, Unknown
  Obtained from environmental sample
gtgaaagtgctcgtcctgggcgcgggtgtggtgggcacggccacggcgctggcgctggcccggcgcggccttgaggtcaccctcgtcgatcgcgagcccgaacccgcccgagggaccagtcatgccaacggcggcggcatcaccccggcccacgccgagccctggaatgcgccgggcatcggctggaagctgctgcgctggctgggccgccgcgacgcgccgttccggctcaggcccgccgcaatccccggcatggcgggctgggggctctccttcctgtggaactcccggcgccggcgcttcctcgtcaacgcccgtgccagcatccggctggcggtgtattcggccgagtgcctggccgaatggcgcgaagccttcgggctgcagtacgagcagcgaacgcttggatccctgaaggtcttctgggaccggggcgagctggtgtccaccataaagctgctggaatcgatcggcgacccgcaggtggagtggagagagctttcgccgcaggcggccgtgcaactcgagccggccctggagccggtggtcgagaaactcgccggcgtgctgcactttccgggcaacgaatcgggggacgcgcgcctgttcagcctggcagcggcggaaaaggcgcgcgagctcggcgcccgactggagttctccaccaatatcgagggtctcgagtgtgacggctggggcttccggcgggtgcgcaccgaccgcggcgtcatcgaggccgatgcctgcatcgtctgcctcggttgcgacagcccggcactgctcggcccgctgggtgtgagcgcgccgatctacccggtaaagggctactcggcgacccttcgcctggccgatcccgcccgagcaccggccggctgcgtgctcgacgccgggcagcgggtgatcgtcacccggctgggagaacgcgtgctcagggtggccggaaccgcggagttcgctggccacgatctggaaatcgaccgtgttcgggcccgctccatgctcgaaagcgcgcgtgcggtgtttccggcgcttggtccggaaatcgaggagcgcgaaccggaattctggaccgggctgcgcccgatgacccccgacggaccaccgctgctcggacgcgccggaccgcggggggtctggttgaacaccgggcatggttccatgggttggacccaggcggccggttcggccgagatcctggccgacctggtgaccggcaagtccccggccatcgacgtctcgggtatggaggcggcgcgctggaacccgtga

SEQ ID NO: 304 - protein, 422 aa, Unknown
  Obtained from environmental sample
  SIGNAL (1)...(18)
  DOMAIN (2)...(402): FAD dependent oxidoreductase
MKVLVLGAGVVGTATALALARRGLEVTLVDREPEPARGTSHANGGGITPAHAEPWNAPGIGWKLLRWLGRRDAPFRLRPAAIPGMAGWGLSFLWNSRRRRFLVNARASIRLAVYSAECLAEWREAFGLQYEQRTLGSLKVFWDRGELVSTIKLLESIGDPQVEWRELSPQAAVQLEPALEPVVEKLAGVLHFPGNESGDARLFSLAAAEKARELGARLEFSTNIEGLECDGWGFRRVRTDRGVIEADACIVCLGCDSPALLGPLGVSAPIYPVKGYSATLRLADPARAPAGCVLDAGQRVIVTRLGERVLRVAGTAEFAGHDLEIDRVRARSMLESARAVFPALGPEIEEREPEFWTGLRPMTPDGPPLLGRAGPRGVWLNTGHGSMGWTQAAGSAEILADLVTGKSPAIDVSGMEAARWNP

SEQ ID NO: 305 - DNA, 1299 bp, Unknown
  Obtained from environmental sample
atgcgagttgtcatactgggaagtggcgtcgttggcgtgaccagcgcctggtacctgagtcaggctggacatgatgtcaccgtcatcgatcgtgaaccgggcccggcgctggaaaccagcgcggcgaacgcggggcagatctctccgggctatgccgcgccctgggctgcgccgggtgtaccgctgaaggcaatcaaatggatgttccagcgccatgcgccgctggccgttcgtctggacggcacacagtttcagttgaagtggatgtggcagatgctgcgcaactgcgacaccagccactacatggaaaacaaagggcggatggtgcgtctggcggaatacagccgtgactgcctgaaagcgctacgtgcgtcgaccggcatccagtatgaagggcggcagggcgggacgctgcaactgttccgtaccgcgcagcagtatgagaacgcaacgcgcgacatcgccgtgctggaagatgccggtgtgccgtatcagttgctggaagccagccgactggcggaagtcgagccggcgctggctgaagtggcgcacaaactgaccggaggcttgcgtctgccgaatgacgaaaccggcgactgccagctctttacccagcgtctggcgcagatggccgaacaggcgggcgtcaaattccgcttcaacacgccggtggataaactgctttgcgaaggcgaacagatttacggcgtgaaatgtggtgatgagatcgttaaagccgatgcgtacgtcatggcgatgggttcctactccacggcgatgctgaaagggattgtcgatattccggtctatccgctgaaaggctattcgctgacgattccgatggcggaagaggacggcgcgccggtttcgactattcttgatgaaacctacaaaatcgccattacccgttttgaccagcgcatccgcgtgggcggcatggcggaaattgtcggtttcaataccgaactactccagccgcgtcgggaaacgcttgagatggtggtgcgcgatctctacccgcgcggtgggcatgttgaacaggcgacattctggaccggtctgcggccgatgacgccggacggtacgccagtcgtggggcgtacccgcttcaaaaatctgttattaaataccggacacggtacgctgggatggacgatggcctgtggttcagggcagttactgagcgatattctgtcaggtcgcacgcctgccattccgtatgacgatttgagcgtggcgcgctaccacgcaggctttacgccttcacgtccccaacatctgcacggcgcacataactaa

SEQ ID NO: 306 - protein, 432 aa, Unknown
  Obtained from environmental sample
  DOMAIN (2)...(397): FAD dependent oxidoreductase
  SITE (151)...(154): N-glycosylation site. Prosite id = PS00001
MRVVILGSGVVGVTSAWYLSQAGHDVTVIDREPGPALETSAANAGQISPGYAAPWAAPGVPLKAIKWMFQRHAPLAVRLDGTQFQLKWMWQMLRNCDTSHYMENKGRMVRLAEYSRDCLKALRASTGIQYEGRQGGTLQLFRTAQQYENATRDIAVLEDAGVPYQLLEASRLAEVEPALAEVAHKLTGGLRLPNDETGDCQLFTQRLAQMAEQAGVKFRFNTPVDKLLCEGEQIYGVKCGDEIVKADAYVMAMGSYSTAMLKGIVDIPVYPLKGYSLTIPMAEEDGAPVSTILDETYKIAITRFDQRIRVGGMAEIVGFNTELLQPRRETLEMVVRDLYPRGGHVEQATFWTGLRPMTPDGTPVVGRTRFKNLLLNTGHGTLGWTMACGSGQLLSDILSGRTPAIPYDDLSVARYHAGFTPSRPQHLHGAHN

SEQ ID NO: 307 - DNA, 1320 bp, Unknown
  Obtained from environmental sample
atgcaatctggcgcaccggaagccaagcgccgcattgtcgcacaagcgcgcgcaggcggccgatactggagttcgagtttgactgacacccttgtccttggcgctggaattgtcggcgtctgcgtggcgatccacctgcaacgccgcggccgcaacgtccttctcgtcgaccgcaagccgcccggacgcgagacctcctacggcaatgccggcatcatccagaaggaaggcgtgcggccacgggccttcccgcgggatctgggcgagctcctgcgtattaccgccgggaaagggctcgacacccgctacgatctcagcgcgctacccggctacgcctcgcccctcgcgcaatactggtggcactcggcaccggagcgctaccgcaagatcgtcgccgaatacgcgccgctgatcgcccacagcgtctccgagcatgccgacctcatcgcagcggccggcgccgagagcctgatcgcaaagcagggatggatggtgatcttccgcacaccccagcgccgcgacgccttcttcgccgacgccgaacgcgacagccgcgaacatggtgttggtatcgccagactcgatggggcagccttggccaaagccgagccggcccttcgcatccctatggcgggcgcgcttcactggaccgatccgtggactgtccgcgaccccggtggactggtcgccgcttatgccgcgcttttcacccggatgggcggcactatcgcaaccggcgacgcgcagacactgaaacagaacggtaccggctggtcggtcgataccgccgatggaccgcagagcgcgaccgaggccgtcattgcgttggggccatggtcacgcgccgcgaccgaaaagctcggctaccgcctgccgctcttcatcaagcgcggctaccaccgcgagtatcgtcaaaccgaagccggcaccctcaaccatccgctgctcgatgccgaaacaggcttcctcatggccccgatgcaacgcggggtgcgcatcacaaccggcgccgagttcgccggcatcgacgcgccgatcaacgcgacccagatcgacggcagcgaatccgctgcccgccagatgatcgatctcggcgaacgcctcgaccctcaaccctggctgggagcccgcccctgcacgcccgatatgaagccaatcatcggccgcgccccgaaccaccccaacctctggttcgccctcggccacgcccatcacggcctcaccctcggcgctgtgacgggccggatgcttgcagagctgttggtgggtgaaactccgttcgttgacgcagcagcgttctcggcgacgcgcttcatgtag

SEQ ID NO: 308 - protein, 439 aa, Unknown
  Obtained from environmental sample
  DOMAIN (29)...(420): FAD dependent oxidoreductase
  SITE (257)...(260): N-glycosylation site. Prosite id = PS00001
  SITE (352)...(355): N-glycosylation site. Prosite id = PS00001
MQSGAPEAKRRIVAQARAGGRYWSSSLTDTLVLGAGIVGVCVAIHLQRRGRNVLLVDRKPPGRETSYGNAGIIQKEGVRPRAFPRDLGELLRITAGKGLDTRYDLSALPGYASPLAQYWWHSAPERYRKIVAEYAPLIAHSVSEHADLIAAAGAESLIAKQGWMVIFRTPQRRDAFFADAERDSREHGVGIARLDGAALAKAEPALRIPMAGALHWTDPWTVRDPGGLVAAYAALFTRMGGTIATGDAQTLKQNGTGWSVDTADGPQSATEAVIALGPWSRAATEKLGYRLPLFIKRGYHREYRQTEAGTLNHPLLDAETGFLMAPMQRGVRITTGAEFAGIDAPINATQIDGSESAARQMIDLGERLDPQPWLGARPCTPDMKPIIGRAPNHPNLWFALGHAHHGLTLGAVTGRMLAELLVGETPFVDAAAFSATRFM

SEQ ID NO: 309 - DNA, 1242 bp, Unknown
  Obtained from environmental sample
atgcatgtaacaataattggcggtggggtaataggattatgctgcgcttattatttaaacaaagaaggatatgaagtaaccgttattgatcgcaaagatattaccgacggctgttcctttggtaatatgggttatatttcccccagccattttactccgttggcaagcccgggcattgtaagccagggattgaaatggatgttgagctcatcatctccattttatatcaaacccaggttaaactggcctcttttacgctggggaatggcattttggaaaaactccaatgcgtcaaaaatgaaggagaacattcctcatcttaataatttattacagttgagccgggaattaatgagtgaattaaaaaaagagttcgatggatcctttaccatgattgaaaaaggttgctggatgttgtatcgaaatccggcaaccggtgaacatgaaaaacatttatcagaccaggcagcagcattgggattaaaaacggtgacctgtagcaggcaggaagtgcaggaccatgaaccggaagtagaggtaaatgtggctggcggagtgttatatattgacgattgccatatcagtgctgctgagtttatgcagaccttacatcattatctggaaaatgcagaggtaaaatttttactgaatacggaagtaaatagtttcgccggcaaaaatttaatcacagaaattgtcaccagcaaagggaacgtaaagacaagtgaagtcatcatcgccaatggctcatggatgccggaactggtaaaaaaattaggcataaaaatattaatgcaacccggcaaaggctatagcgtcgtgtatgatggtcttgaaaaaaacctgcactacccatccatattggtggatgacagaacggctacaacgcccattgatcgctggttacgcataggtggaaccatggaattaagcggccacagcggtactattttaccaaaaagagtgatggctttatacaatgcattcaaaaaatattatccaacacttgacatttcacctccgcaaattgggcaagcctggtttggctatcgccctgtaactcctgatggccttccatacattggaaaattttccaaattgtctaatgtgacgttcgccggtggtcatgccatgttgggcgtatcagccgctgcggccaccgggaaactcgttgctgagatcatcagtcaccggcctactgctatcgatatagccgcatttgatccggcaagattttcctaa

SEQ ID NO: 310 - protein, 413 aa, Unknown
  Obtained from environmental sample
  DOMAIN (2)...(394): FAD dependent oxidoreductase
  SITE (97)...(100): N-glycosylation site. Prosite id = PS00001
  SITE (251)...(254): N-glycosylation site. Prosite id = PS00001
  SITE (374)...(377): N-glycosylation site. Prosite id = PS00001
MHVTIIGGGVIGLCCAYYLNKEGYEVTVIDRKDITDGCSFGNMGYISPSHFTPLASPGIVSQGLKWMLSSSSPFYIKPRLNWPLLRWGMAFWKNSNASKMKENIPHLNNLLQLSRELMSELKKEFDGSFTMIEKGCWMLYRNPATGEHEKHLSDQAAALGLKTVTCSRQEVQDHEPEVEVNVAGGVLYIDDCHISAAEFMQTLHHYLENAEVKFLLNTEVNSFAGKNLITEIVTSKGNVKTSEVIIANGSWMPELVKKLGIKILMQPGKGYSVVYDGLEKNLHYPSILVDDRTATTPIDRWLRIGGTMELSGHSGTILPKRVMALYNAFKKYYPTLDISPPQIGQAWFGYRPVTPDGLPYIGKFSKLSNVTFAGGHAMLGVSAAAATGKLVAEIISHRPTAIDIAAFDPARFS

SEQ ID NO: 311 - DNA, 1266 bp, Unknown
  Obtained from environmental sample
gtgaaagttttgatcctcggcagcggtgtcatcggtgtcacctctgcctactacctcgcacgtgccggccacgaagtgacggtcgttgaccgtcagccggaaccggcgctggagacctccttcgccaatgccggcgaagtctcgcccggctattcctcgccctgggccggtcccggcgtgccggtgaaggcgatcaagtggctgttgatgaagcacggcccgctggtgatccggccgaagctcgatcccgtgatgtgggtctggctcgccaagatgctgcgcaactgcaccagcgcgcgctacgcggtcaacaagagccggatgatcccgatcgcggagtacagccgcgattgcctgcgcgatttgcgccgcgacatcggcattcaatacgacgagcgctcgcagggcacgctgcagctcttccgctatcaggcgcagctcgacggcacggctgaggacatcgccgtgctcaagcagtacggcgtgccttacgaggtgctgagccgcgagggctgcattgcggtcgagccggcgctggcgggtgtgaaggaaaagttcgccggcgggcttcgcctgccgcaggacgagaccggcgactgccacatgttcacgcaggcgctggccaagcatgccgaagcgctcggcgtccgcttcctgttcaacaccggcatcgaccgcatcgtcacggacggcgcgcgcgtcagcggtgtcgcgaccagtgccggcatgctgcaggcagacagctacgtcctcgcgctcggaagctggtcgtcgcgcctcgttgcgccgctcggcatttcgctgccagtctatccggtgaagggttattcgatcacggtgccgatcaaggacgcctccggcgcgccggaatcgaccgtgatggacgagagctacaaggtcgcgatcacccgtctcggcaatcgcatccgcgtcggcggcaccgccgaaatctccggcttctcgagccagctctacgacgcgcgccgcgccacgctcgatcattccttgaccgacctgtttccgcgcggcggcgatctctctaaggcgacgttctggagcggcctgcgcccgatgacgcccgacggcccgcccgtgatcggcccgacgcaatacggtaacctccatctcaacaccggccacggcacgcttggctggaccatgtcgtgcggctccggccgggtgctcgcggacatgctgtcgggcaagaagccggacgtcgacgtcagtgcgctgacggcggatcggtataatcaccggtttgggtga

SEQ ID NO: 312 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
MKVLILGSGVIGVTSAYYLARAGHEVTVVDRQPEPALETSFANAGEVSPGYSSPWAGPGVPVKAIKWLLMKHGPLVIRPKLDPVMWVWLAKMLRNCTSARYAVNKSRMIPIAEYSRDCLRDLRRDIGIQYDERSQGTLQLFRYQAQLDGTAEDIAVLKQYGVPYEVLSREGCIAVEPALAGVKEKFAGGLRLPQDETGDCHMFTQALAKHAEALGVRFLFNTGIDRIVTDGARVSGVATSAGMLQADSYVLALGSWSSRLVAPLGISLPVYPVKGYSITVPIKDASGAPESTVMDESYKVAITRLGNRIRVGGTAEISGFSSQLYDARRATLDHSLTDLFPRGGDLSKATFWSGLRPMTPDGPPVIGPTQYGNLHLNTGHGTLGWTMSCGSGRVLADMLSGKKPDVDVSALTADRYNHRFG

SEQ ID NO: 313 - DNA, 1245 bp, Unknown
  Obtained from environmental sample
gtggcacgtactgatgcgatggtcctcggcgccggcattgtcggcacatcggttgcgctacatctcgccaaacgcggtttgagtgtcgccttggtagaccgcgcgggcgtcggcgagcagacttcctatggcaacgccggcatcatcgaaggcaacactgtattcccgccggcatttccttccgatcttgacgcactgctccgcatcgccttcaagcgcgcgggcgaggccaactatcatttgtcgtttctgcctcgggtacttccctggctgctggcatttcgcgccgcctcgcaacccaaacgtctggcggaaacggctcgattgatccgtcccttgttttcccgggcagtcgccgagcacgaggcgttgatgaccgagtctggcgcgacgcactatttgcgcaagacaggctggttgaaggtttatcgcgaagacaggagttttgctgctttgtcgtctgagttcgatctggctgcgaaattcggcttgccgctaaagactctcgataccgcgggtgcgcaggcgctcgagccgtcgctcaatccggttttctcgcacgcggtgttctggccggaagcagccagtgtcagcagtcctcttggcgtaacgcgcgcctatgcaaaacgctttaccgcactgggcggcgtcattgtcgcaggtgacgcccagtcgctgcatcgaagcagaaaaaactggcgagtggagaccaatgaaggcgcactcgatgccgagcaatgcgtcgtggccctcgggccgtgggcgaccgatttgctggaccgcctcggcctcaaactgccgcttgccgtcaagcgaggctatcacaggcattttcgcgccgtgggcaacgccggcttggcgcgcccggtgctcgacgccgacgtgggctatctgatgacgccgatggagcagggcatccggataaccacgggtgccgaattcgcctcgcgcgatgcgccgccgagcccggcgcagttttcgcgcattacgccacgagcgcgtgaactctttccgttgggcgaactggccgaggacaagacatggctcgggagccggccgtgctttcccgattcccgcccagtgatcggccgcgcacccggattagggggcttgtggctcgcgattggccacgcccattggggcctcacactcggtccggccacaggtcggatgatcgccgaaatgatcacgggcgagcagccattttgcgatccggccccttaccgcgccgaacgcttccattag

SEQ ID NO: 314 - protein, 414 aa, Unknown
  Obtained from environmental sample
  DOMAIN (5)...(395): FAD dependent oxidoreductase
MARTDAMVLGAGIVGTSVALHLAKRGLSVALVDRAGVGEQTSYGNAGIIEGNTVFPPAFPSDLDALLRIAFKRAGEANYHLSFLPRVLPWLLAFRAASQPKRLAETARLIRPLFSRAVAEHEALMTESGATHYLRKTGWLKVYREDRSFAALSSEFDLAAKFGLPLKTLDTAGAQALEPSLNPVFSHAVFWPEAASVSSPLGVTRAYAKRFTALGGVIVAGDAQSLHRSRKNWRVETNEGALDAEQCVVALGPWATDLLDRLGLKLPLAVKRGYHRHFRAVGNAGLARPVLDADVGYLMTPMEQGIRITTGAEFASRDAPPSPAQFSRITPRARELFPLGELAEDKTWLGSRPCFPDSRPVIGRAPGLGGLWLAIGHAHWGLTLGPATGRMIAEMITGEQPFCDPAPYRAERFH

SEQ ID NO: 315 - DNA, 1236 bp, Unknown
  Obtained from environmental sample
atgtccgctgatgtcatcgtcctcggagccggcatggtcggtgcgtgcacggcgttgcagctcgcgcgtcgcgggcacgccgttgcgctggtcgatcgccgggcacccgggcgcgagacttcctacggcaacgctggaatcatccagcgcgaagcagtcgagccctatgcctttccgcgcgagtggtcggcggtcttcgacgtcgcgttcaagcgcggcatcgacgtcaactaccacctgagcgcgctgccggaggtcctgccgcggctcgcacgctactggcatgcctcggcgcccgcgcgctacgcgccgatcgcgcaggcctacagccgattgatcgagcattgcctgaccgagcatgaggttctcatcgccgagtccggtgcggacgacctcgtgcgcaaggaagggtatcgcttcgtctttcgctcgtcggccgcgatggacgaggcagcggcccgtgcggccaggctcgccgccgactacggcgtgaggcatgccgttcaggacggcgacgaattgggcagggcggaaccgggcctgcgccaacgcatggccggcgcgctgcactggctcgacccctggtccgtgagcgacccgggcgcactggtggcacgctacgcccgacgcttcgaggcgctgggcgggcaactggtcgagggcgatgcaaccagcttgcgggctgcaggtggcggatggcaggtccagacaaccgccgggccgctgactgcacgccatgccgtcgtggctctcggcccttgggcggatgcgctgatcgcaccgctcggctatcggctgcccctgttcgtcaagcgcggctaccaccgtcactatcgcggcggacccggcctgcggttgccgatgctcgatgccgaacgcggtctggtgctggcgcccatggcgcagggcgttcgccttacgacgggcgcggagttcgcccgcatcggtgcgccggccacgccggtacaactcacgaaagcggaagccgcggcgcgcgagatcctcgatctgcgggaccctgtcgaatccgagccctgggtcggcaaccgtccatgcaccgcagacatgaagccggtcatcggaccggcgccgaagcaccccggcctctggttcaacttcgggcacgcgcaccaggggttcacgctggggcctgcgagtgggcggctggtggcagacatgatcgagggagccactcccttgatcgacccggccccttatctgccaagccgcttctag

SEQ ID NO: 316 - protein, 411 aa, Unknown
  Obtained from environmental sample
  DOMAIN (4)...(393): FAD dependent oxidoreductase
MSADVIVLGAGMVGACTALQLARRGHAVALVDRRAPGRETSYGNAGIIQREAVEPYAFPREWSAVFDVAFKRGIDVNYHLSALPEVLPRLARYWHASAPARYAPIAQAYSRLIEHCLTEHEVLIAESGADDLVRKEGYRFVFRSSAAMDEAAARAARLAADYGVRHAVQDGDELGRAEPGLRQRMAGALHWLDPWSVSDPGALVARYARRFEALGGQLVEGDATSLRAAGGGWQVQTTAGPLTARHAVVALGPWADALIAPLGYRLPLFVKRGYHRHYRGGPGLRLPMLDAERGLVLAPMAQGVRLTTGAEFARIGAPATPVQLTKAEAAAREILDLRDPVESEPWVGNRPCTADMKPVIGPAPKHPGLWFNFGHAHQGFTLGPASGRLVADMIEGATPLIDPAPYLPSRF

SEQ ID NO: 317 - DNA, 1245 bp, Unknown
  Obtained from environmental sample
atgagcaaagtaactattataggaggcggcattatcgggttgagttctgcgtattatttacagcgtgcaggatgggatgttacggtaattgacaaggaggattttttggataactgttcctacggcaacgcgggctatgtttgcccgagccattttattccgctggccacaccaggcattattaagcagggtttaaaatggatgctgaattccaaaagccctttttatgttcagccaaagctgagcaaggcattgttcgactggggcttcaggtttatgaaaagtgctaccgaagagcatgtggaaaggtccgctgttcccttgcgcgatatcgctttactcagccagcaggaatatgaacaatggaccaaagaggtcggatttgatttcgcttacgagcataaaggtttattggaaatattccagaccgaagccaatgcggaacatgccaaacatactgttgagaaggcgcacaagcttggattggatactgagttgctcaattatgagcagatgcaggcactggagccacacacaaagatcaatggtttaggcgccattttctttaaatgtgatggccacctgtatcccaataaactgatgaaagggcttatcctcaagcttaaagagcttggcgttaaattattaccgcgccaggaggctgttcgttttgaaaagaaaggcaactccgttacgaaggtgattactgctgatcaaagttttgaaacagatcatgtagttgtagcaacaggatcctggagtcgtgaagtggcggctttactagatgtaagaattccgcttatgccgggcagaggctattctgtaacactagaaaattctccctacaaagttaactacccatctattttagttgaaggccgtgtggctatcacgccaatggatggtaacaagatccgtttcggcggaacgatggaagttgtatccactaatacaccgccacgctacaaccgtgttgaaggaatattaaaggctgtgaaaagcttttatcctgattttaatgtatccatgccatcaacagataagatctggtatggatacaggccatgctctgcagatggattgccctatattggcaagacaaataaatggggtaacgttaccattgctaccggtcactctatgctgggattaagtcttggcgcaggaacggggaaactggttacagagctggttaatgaaacagcgactagcattgacttgaagccttttgcggtggagagataa

SEQ ID NO: 318 - protein, 414 aa, Unknown
  Obtained from environmental sample
  DOMAIN (3)...(397): FAD dependent oxidoreductase
  SITE (38)...(41): N-glycosylation site. Prosite id = PS00001
  SITE (345)...(348): N-glycosylation site. Prosite id = PS00001
  SITE (377)...(380): N-glycosylation site. Prosite id = PS00001
  SITE (405)...(408): N-glycosylation site. Prosite id = PS00001
MSKVTIIGGGIIGLSSAYYLQRAGWDVTVIDKEDFLDNCSYGNAGYVCPSHFIPLATPGIIKQGLKWMLNSKSPFYVQPKLSKALFDWGFRFMKSATEEHVERSAVPLRDIALLSQQEYEQWTKEVGFDFAYEHKGLLEIFQTEANAEHAKHTVEKAHKLGLDTELLNYEQMQALEPHTKINGLGAIFFKCDGHLYPNKLMKGLILKLKELGVKLLPRQEAVRFEKKGNSVTKVITADQSFETDHVVVATGSWSREVAALLDVRIPLMPGRGYSVTLENSPYKVNYPSILVEGRVAITPMDGNKIRFGGTMEVVSTNTPPRYNRVEGILKAVKSFYPDFNVSMPSTDKIWYGYRPCSADGLPYIGKTNKWGNVTIATGHSMLGLSLGAGTGKLVTELVNETATSIDLKPFAVER

SEQ ID NO: 319 - DNA, 1110 bp, Unknown
  Obtained from environmental sample
ttgaaatcggcgcggccagtgaaaaccgtcggtatcgccggtgcgggcaccatgggccgcggcatcgcggccgcctgtttaaagtcaggcttgagcgtggtcctggtcgatagtgatgccaggacgctcgagcgagcccgcccggcgctggccgatagcctgacgcgcctggcgcggtcggaccaatggccggagggtgaggctgaacgaaaactcgccgccctctccctggctaataccctcgacgcccttggcagttgcgatttgatcgtcgaggctgtgtttgaggatgaagcggtgaagcgttctgctcttgctgcgatcggcaaggtcgcgcgcagcgatgcggtgatcgccacaaacacgtcatacctcgacatcgatcgcctggcggatgcctgccctgatccggcacgcttcataggcctgcacttcttcgccccggctgaaatcatgcggttggtggaagcgatccgcggcaaggccagcagcccgcagagcctcgccaccggcgtccagttcatcaggaaactcggcaaggcgcccgtgctcgccggcatgtgcgaaggattcatcgtcaaccgaattctcgccgcatatcggcgcgagatggaagttttgctggaagaaggagccctgcccgcggatgtcgacggcgccctcgagaagttcgggatggccatggggactttcgccgtcgccgatctttccgggctggacatcagctgggcgcggcgcaagcggctgcgcgccacgcagaatccgccgcctcgtttctttccggtcgccgattggctgtgcgaaagcggccgcttcggccgcaagactggcgcgggctggtatcgttatgaaggcggcaaacgcatggtcgatgaacgcgtcaccatgctgattgaacgggcctcggcggaaagcaatgttacgcggcggccaattgcgttcgaggagatcgtcgaacgggccttgtccatcatgcgaagcgaggcacagaaaattctggcagaaggcatggcgctgcgcgcgagcgatatcgacttcgccctcgtcaacgcacttggctttccggcgtggcgcggcgggccgctttatatggcccagagtaaaggatag

SEQ ID NO: 320 - protein, 369 aa, Unknown
  Obtained from environmental sample
  SIGNAL (1)...(25)
  DOMAIN (9)...(188): 3-hydroxyacyl-CoA dehydrogenase, NAD binding domain
  DOMAIN (190)...(283): 3-hydroxyacyl-CoA dehydrogenase, C-terminal domain
  SITE (122)...(125): N-glycosylation site. Prosite id = PS00001
  SITE (310)...(313): N-glycosylation site. Prosite id = PS00001
MKSARPVKTVGIAGAGTMGRGIAAACLKSGLSVVLVDSDARTLERARPALADSLTRLARSDQWPEGEAERKLAALSLANTLDALGSCDLIVEAVFEDEAVKRSALAAIGKVARSDAVIATNTSYLDIDRLADACPDPARFIGLHFFAPAEIMRLVEAIRGKASSPQSLATGVQFIRKLGKAPVLAGMCEGFIVNRILAAYRREMEVLLEEGALPADVDGALEKFGMAMGTFAVADLSGLDISWARRKRLRATQNPPPRFFPVADWLCESGRFGRKTGAGWYRYEGGKRMVDERVTMLIERASAESNVTRRPIAFEEIVERALSIMRSEAQKILAEGMALRASDIDFALVNALGFPAWRGGPLYMAQSKG

SEQ ID NO: 321 - DNA, 1248 bp, Unknown
  Obtained from environmental sample
atgaagttcgacactattgtgctgggcgcgggcatcgtaggggtatcgattgcagtgcatttgcaaaagctcggccgctcggtcgcgctcgtggatcgcaagcgtccgggcctcgagacatcgtttggaaatgccggactgctgcagcgcgaaggggtgtatccgtacgcgcttcctcgcgacatcagcacgtggatgcattacgcaaagaatgactccatcgatgtccattaccaccgcgacgcgcttcccgcgcttgcgcctttcctctggacgtactggcgcaactcggaacccgcgaagcacgcggccatcgcgcgtcaatacgcaacgctgatcgaacattgcgtgaccgagcatgaagtcctcgcgcgcgaggcgggcgtcacggatttgctcaagccaacgggctggatcaaggtcttccacaccaacgccgcacaggacgatgaagcgcgcgatgcagaacgctggcatcgtgaattcggtgtgcattacacgctgctcgatcctgccacgttgcagaagaccgagccgcatctggacccatcgctagtgggcggattgcattacacggacgcggtatcggtcaatgatccgggcgcgctggtcgcgggttatgccgcgtatttcgagcggctgggcggacgtttcttcaacggcgacgcgaccacccttgccgaagatggcaacggctggcgcgtgatgacggaggaagggcaggtcaacgcatcgactgcagtgatcgcgctggggccatgggcgaaggacgtgaccgcggcgctgggatatcggttgccgctcgcggtgaagcgcggctatcacatgcactacacgccgcagccgggcacggtgctgaaccatccggtactcgatgtcgacaacggtttcctgcttgcgccaatggcgcgcggcatccgcctgacgacaggcgtggagctggccgaacgcgatgcgccgaagacacccgtgcaactgctgcgcgccgagcctgtggcgcggactctgttcccgctcggggagcgtgtagacgatgaaccctggatgggccgccgtccgtgcacgcctgacatgatgccgatcatcggacctgcgccgcgtcacaagaacatgtggttcgcattcggccacgcgcatcatgggctcacgctcggcgcggtgacgggcaggctgattgcatccatgatgacgggtgaagaaccgttcatcgataccacgccgttcagggcagaccgctttgcggcttag

SEQ ID NO: 322 - protein, 415 aa, Unknown
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001
MKFDTIVLGAGIVGVSIAVHLQKLGRSVALVDRKRPGLETSFGNAGLLQREGVYPYALPRDISTWMHYAKNDSIDVHYHRDALPALAPFLWTYWRNSEPAKHAAIARQYATLIEHCVTEHEVLAREAGVTDLLKPTGWIKVFHTNAAQDDEARDAERWHREFGVHYTLLDPATLQKTEPHLDPSLVGGLHYTDAVSVNDPGALVAGYAAYFERLGGRFFNGDATTLAEDGNGWRVMTEEGQVNASTAVIALGPWAKDVTAALGYRLPLAVKRGYHMHYTPQPGTVLNHPVLDVDNGFLLAPMARGIRLTTGVELAERDAPKTPVQLLRAEPVARTLFPLGERVDDEPWMGRRPCTPDMMPIIGPAPRHKNMWFAFGHAHHGLTLGAVTGRLIASMMTGEEPFIDTTPFRADRFAA

SEQ ID NO: 323 - DNA, 1245 bp, Unknown
  Obtained from environmental sample
atgcattgccagacccttgtcctcggcgccggcatcgtcggcgtcagcaccgcgctgcacctgcaggcccgcgggcgccaggtgatcctgatcgaccgcgacgaaccgggcagcggcaccagccacggcaacgccgggttgatcgagcgctccagcgtcatcccctatgcctttccccggcaactgggcgcattgctgcgctacggcctgaaccgccagcccgatgtgcgctacagcctggcgcacctgcccaaggccgcgccgtggctgtggcgctactggcgtcagtcagcccctggtcggctggccggtgccgccgctgacatgctgccgctggtgcagcgctgcgtcgaagaacacgacgcgctcatcgctgctgccggccttgaagggctggtgcaggccaaagggtggatcgaagtgttccgcgacccggccctgttcgagcaggccaaggccgacgccaagggcctgagccgctatggcctgcaatttgaaatccttgaatgcgggcaactgcaggcccgcgagcaccagctggacgccaccgtggtcggcggcatccactggctcgacccgaagaccgtgaacaaccccggcgccctcacccgtggctacgcggcgctgttccagcaacgcggcgggcagttcctgcatggtgatgcacgcagcctgcgtcaggccaacggccaatggcgggtcgagagccgccgcggcccgattaccgccgacgaagtggtggcctgcctaggcccacagtcggccgacctgttcagcggcctgggctaccagatcccgctggcgatcaagcgcggttaccacatgcactacagcacccgtgacggcgcgcaactggagcattccatttgcgacacccagggcggctatgtgctggcaccgatggcgcgcggtgtgcgcctgaccaccggcatcgagttcgacgcagccagcgcgcccggcaaccagatccagctgggccgctgcgaggccctggcgcgcaagctgttcccggccttgggcgaacgcctcgatgacacgccgtggctgggccgtcgcccgtgcctgcccgacatgcgcccggtgatcggcccggcaccccgccacccggggctgtggttcaacttcggccacgcccaccacgggctcaccctgggcccggtcagcggtcggctggtggccgagctgatcaccggcgaacaccccttcaccgaccccgcgccctacagcgcgacccgtttcgactga

SEQ ID NO: 324 - protein, 414 aa, Unknown
  Obtained from environmental sample
  DOMAIN (4)...(395): FAD dependent oxidoreductase
MHCQTLVLGAGIVGVSTALHLQARGRQVILIDRDEPGSGTSHGNAGLIERSSVIPYAFPRQLGALLRYGLNRQPDVRYSLAHLPKAAPWLWRYWRQSAPGRLAGAAADMLPLVQRCVEEHDALIAAAGLEGLVQAKGWIEVFRDPALFEQAKADAKGLSRYGLQFEILECGQLQAREHQLDATVVGGIHWLDPKTVNNPGALTRGYAALFQQRGGQFLHGDARSLRQANGQWRVESRRGPITADEVVACLGPQSADLFSGLGYQIPLAIKRGYHMHYSTRDGAQLEHSICDTQGGYVLAPMARGVRLTTGIEFDAASAPGNQIQLGRCEALARKLFPALGERLDDTPWLGRRPCLPDMRPVIGPAPRHPGLWFNFGHAHHGLTLGPVSGRLVAELITGEHPFTDPAPYSATRFD

SEQ ID NO: 325 - DNA, 1299 bp, Unknown
  Obtained from environmental sample
atgcgagttctggtacttggtagcggcgtaatcggaaccgccagtgcctactacctggcccggcaaggtttcgaagtgacggtggtcgaccgccagccggcggtggccatggaaaccagttttgccaacgccggtcagatctcgcccggctatgcctcgccctgggccgcacctggtgtaccgctgaaggccgtgaagtggctgctggagcgccacgcccctctggccatcaagctgaccggtgacgtcgaccagtacctgtggatggcgcagatgctgcgcaactgcactgccagccgttatgcggtgaacaaggagcgcatggtgcgcctgtccgagtacagccgtgactgcctcgacgagctgcgcgccgaaaccggcatcaattacgaaaaccgcagcctgggcactacccaactgttccgtacccaggcccaggttgatgctgcggccaaggacattgccgtgctcgaacagtccggcgtgccttacgaattgctcgaccgcgacggcattgcccgcgttgaaccggccctggctggcgtgaaagacatcctggccggcgccctgcgcttgcccaacgaccaaactggcgactgccagttgttcaccaccaagctcgccgacatggcgctgaagctgggcgtggagttccgctttggccaggacatccagcgcctggacttcgccggcgaccgcatcaacggtgtgtggatcgacggcaagctggaaaccgccgaccgctacgtgctggcgctgggcagctactcgccgcagatgctcaagccgctgggcatcaaggccccggtctatccgctgaaaggctactcgctgaccgtgccgatcaccaacggcgacatggccccgacgtcgaccatcctcgacgaaacctacaaggttgcgatcacccgtttcgacaatcgcatccgcgtcggcggcatggctgaaatcgccggttttgacctgtcgctgaacccgcgtcggcgcgaaacgctggagatgatcgtcaacgacctttatcctcgcggcggtgacctgagccaagccagtttctggaccggcctgcgcccggcgaccccggacggtacaccgattgtgggtgcgaccgcgttccgcaacctgttcctgaacaccggtcacggtactttgggctggaccatggcgtgcggctccggtcgtctgctggccgacctgattgcgcgcaagaagccgcagatcagtgccgaaggcctggacatttcccgttatggcaacagcccggaagtggccaagcatgggcaggctgcaccctcgtgccga

SEQ ID NO: 326 - protein, 433 aa, Unknown
  Obtained from environmental sample
  DOMAIN (2)...(398): FAD dependent oxidoreductase
  SITE (96)...(99): N-glycosylation site. Prosite id = PS00001
  SITE (134)...(137): N-glycosylation site. Prosite id = PS00001
MRVLVLGSGVIGTASAYYLARQGFEVTVVDRQPAVAMETSFANAGQISPGYASPWAAPGVPLKAVKWLLERHAPLAIKLTGDVDQYLWMAQMLRNCTASRYAVNKERMVRLSEYSRDCLDELRAETGINYENRSLGTTQLFRTQAQVDAAAKDIAVLEQSGVPYELLDRDGIARVEPALAGVKDILAGALRLPNDQTGDCQLFTTKLADMALKLGVEFRFGQDIQRLDFAGDRINGVWIDGKLETADRYVLALGSYSPQMLKPLGIKAPVYPLKGYSLTVPITNGDMAPTSTILDETYKVAITRFDNRIRVGGMAEIAGFDLSLNPRRRETLEMIVNDLYPRGGDLSQASFWTGLRPATPDGTPIVGATAFRNLFLNTGHGTLGWTMACGSGRLLADLIARKKPQISAEGLDISRYGNSPEVAKHGQAAPSCR

SEQ ID NO: 327 - DNA, 1254 bp, Unknown
  Obtained from environmental sample
atgacagcagcaaagtcggacgttctgattctcggcggcggcgtgatcggtctcgcctgcgcgcattacctgctcgaggccggccgcagcgtgaccgtgctcgaacaggcgacgctcggcagcggcagctcgcacggcaactgcggcacgctgacgccgagccacgcgacgccgctggcgatgccgggcgtgatcggcacggcgctgcgctggctgctgaaacccgatgcaccgctgcgcatcaagccgcgtttcgatccggcgctgctgcgctggctgctcggtttcgccgcgcattgcaattggcaggatgccgtgcgcgcgacgatggcgaaggcgccgctgctgatccgctcgcgcgagctgatcgaggagctcgtgcgcacacagcggctcgcctgcgaattcgaagcgctcggcaccttgaacgtatttcgcgacgcggcgaatttcgagcacgcgcgcgaatcgctgtcgctgctcgccgatgccggcatccgcgtcgatgtgctcgatgcggcgcaaacgctcgcgcgcgaaccggcgctcaagcccggtgtcgccggcgcgttcttcaatccaggcgacgcccagctacgcccggatcgatatgtcgcggaactggcgcgctgcgtgcgtacacgcggcggacggatcgaggaaggcgcgcgcatcgatggcttgctgcttgaaggcagccgcatcgtcgaggcgacgacgtcgaaaggcagcttcagcgggcgcgatgtcgtgttcgcgctcggtgcgtggtcgccggcgctggcacgtccgctcggtctgcgcattccaatccagccgggcaagggttattcgatcacctatacacgcccgctgcgctgcccgcgcattccgatgaccttgaaggaaccgagcgtgtgcgtgacggcctggggctcaggtttccgcctcggcagcacgatggaattcgccggctatgacggtaccctcaatcgcacgcgactggatgcgctgaaacgcggcgcgtcgacgttcctgcacgaaccggaaggtcccgctctcgtcgaggagtggtacggctggcggccgatgacgccggacgacctaccgttgctcggccgcgcgcccggcatcgacaatctcgtgttggcgaccggtcatggcatgctcggcgtcagtctttctgcgataacggggctgctggtgagcgagatcgttgtgggcgttccgccttctttcgatctggcgccgtttgccgcagcgcgctttcagtga

SEQ ID NO: 328 - protein, 417 aa, Unknown
  Obtained from environmental sample
  DOMAIN (7)...(398): FAD dependent oxidoreductase
MTAAKSDVLILGGGVIGLACAHYLLEAGRSVTVLEQATLGSGSSHGNCGTLTPSHATPLAMPGVIGTALRWLLKPDAPLRIKPRFDPALLRWLLGFAAHCNWQDAVRATMAKAPLLIRSRELIEELVRTQRLACEFEALGTLNVFRDAANFEHARESLSLLADAGIRVDVLDAAQTLAREPALKPGVAGAFFNPGDAQLRPDRYVAELARCVRTRGGRIEEGARIDGLLLEGSRIVEATTSKGSFSGRDVVFALGAWSPALARPLGLRIPIQPGKGYSITYTRPLRCPRIPMTLKEPSVCVTAWGSGFRLGSTMEFAGYDGTLNRTRLDALKRGASTFLHEPEGPALVEEWYGWRPMTPDDLPLLGRAPGIDNLVLATGHGMLGVSLSAITGLLVSEIVVGVPPSFDLAPFAAARFQ

SEQ ID NO: 329 - DNA, 1251 bp, Unknown
  Obtained from environmental sample
atgagtaatataacagtagttggcggaggcattatcggtttaagctctgcattttatcttcaaaaagccggacataaagttaccgtaattgacaaagatgatttctcaaacaattgctcgtacgggaatgcgggctatgtttgccccagccattttgttccgctggcaacaccgggcatagtatggaaggggtttaaatggatgttcaattcgcaaagcccgttttatgtgcaaccgtctctgaaaagcgcattgattgactggggggtaaaatttgcgaaaagcgccaatgataagcacgtggcagcttcggctatccctttacgtgatatagctattttaagtcagaaagaatatgaacaatggacaaccataccgggttttgattttgcgtatgagcataagggtctgcttgaaatttttcagacagaagcggtgggtgagcacgcccgtcacacggttgaaaaagcaaacgcattaggcctggatactaagtttttgaatgcggatgaattgcagcaattagaaccgcaaacaaaaattaaagctttgggcgccatactgtttaaatgtgatgcccacctgtacccgcagaaattaatgcatgggttattaaatatattaaagcagagcggtgtgcagctggtacccaacgaaacagtaataagattcgagaaaaaaggaaacagcattaacaaggtgatcactgcaaccaatacttatgataccgaccaggttgttattgccaccggcgcctggacgcgggaaatagcctcactggctgatacaaaaattccattgatgcccgggcgcggttattccattaccctcgaaaattcaccttaccgcatcaatcatcctgctgtgctgatagaaggcagggttgctctcacaccgatggacggaaacaaaataaggtttggcggaactatggaagtggtgcctacggatactcccccacgttacaaacgtgtggaaggcattatcaatgccgttaaaagatactacactgaatttgacattcccatgccgcatgaaaaagacatctggtatggttacagaccctgctcggcagacgggcttccttatatcggcaaaataaaacggtataacaatgtggttatagccaccggtcatgccatgatcggtttaagcacaggcgcaggaacgggcaggctggtatctgaaattgtgaatgagcaaaaaacaagtatagatattattccttttgctgtggaaaggttcggttaa

SEQ ID NO: 330 - protein, 416 aa, Unknown
  Obtained from environmental sample
  DOMAIN (3)...(397): FAD dependent oxidoreductase
  SITE (3)...(6): N-glycosylation site. Prosite id = PS00001
  SITE (38)...(41): N-glycosylation site. Prosite id = PS00001
  SITE (221)...(224): N-glycosylation site. Prosite id = PS00001
  SITE (292)...(318): Ribosomal protein L14 signature. Prosite id = PS00049
MSNITVVGGGIIGLSSAFYLQKAGHKVTVIDKDDFSNNCSYGNAGYVCPSHFVPLATPGIVWKGFKWMFNSQSPFYVQPSLKSALIDWGVKFAKSANDKHVAASAIPLRDIAILSQKEYEQWTTIPGFDFAYEHKGLLEIFQTEAVGEHARHTVEKANALGLDTKFLNADELQQLEPQTKIKALGAILFKCDAHLYPQKLMHGLLNILKQSGVQLVPNETVIRFEKKGNSINKVITATNTYDTDQVVIATGAWTREIASLADTKIPLMPGRGYSITLENSPYRINHPAVLIEGRVALTPMDGNKIRFGGTMEVVPTDTPPRYKRVEGIINAVKRYYTEFDIPMPHEKDIWYGYRPCSADGLPYIGKIKRYNNVVIATGHAMIGLSTGAGTGRLVSEIVNEQKTSIDIIPFAVERFG

SEQ ID NO: 331 - DNA, 1266 bp, Unknown
  Obtained from environmental sample
ttgaacgttctcattcttggcggcggcgtcattggcgtgacgtctgcctactatcttgccaaagcgggccatgcggtcacggtcgtcgaccgccagcccgatgttgcccttgaaacatcattcgccaacgccggcgaggtatcgcccggttatgcctcaccctgggccggccccggcgtgccgataaaagcgatcaaatggttgttaatgacgcacggcccgctggtgatccggcccaagctcgatcccgcaatgtgggtcttcatggccaagatgctgcgcaactgcaccgatgcgcgctacgcggtcaacaagggccggatgattccgatcgcagagtatagccgtgactgcctgcgcgcgctgcgcgccgacattggcattcactatgatgagaagagccgcggcacactgcagctgttccgcaagcaggaacagcttgatcacactggcggcgatattgccgtgctcaagcagtatggcgtgccttatgaggtgctcgaccgcaccggctgcatcgccgccgagcctgcgcttgccgcagtaaaaggcaagtttgttggcggtctgcgcctgccccaggacgagaccggcgattgccacatgtttacccaggcgcttgccgcacgcgcggcagagcttggcgtgcagttcaaatttgcgacctcgatccagcagcttattgttgagggcaagcacgtctccggcgttgccacctcggccgggctcatgaaggctgacgcctatgtcgtcgcgctcgggagctggtcgccgcatctgctgcggccgctcggcatctcgatccccgtctatcccgtcaagggctattccatcaccgtgccggtggccgacacggccgctgcgccggtctcgaccgtgatggacgagagctacaaggtcgcgatcacgcggcttggaaagcgcattcgcgtcggaggtaccgcggagatctcaggctactccaacactctgcacgccgcgcggcgtgccacgcttgaccattcgctgactgacctgtttccgggcggcggcgatctcagggatacaaagttctggagcggcctgcgcccgatgacgcctgacggcccgccgctgatcgggccgacaccttatgcgaacctgcatctcaacaccggccacggcacgctgggatggacaatggcgtgcggctccgggcgcgtgcttgcggataccttgagcggccgcaagccggacgtcgacatcagcgaactcgcgatgacacgttacgagacgcgcttcgggtga

SEQ ID NO: 332 - protein, 421 aa, Unknown
  Obtained from environmental sample
  DOMAIN (2)...(398): FAD dependent oxidoreductase
  SITE (96)...(99): N-glycosylation site. Prosite id = PS00001
MNVLILGGGVIGVTSAYYLAKAGHAVTVVDRQPDVALETSFANAGEVSPGYASPWAGPGVPIKAIKWLLMTHGPLVIRPKLDPAMWVFMAKMLRNCTDARYAVNKGRMIPIAEYSRDCLRALRADIGIHYDEKSRGTLQLFRKQEQLDHTGGDIAVLKQYGVPYEVLDRTGCIAAEPALAAVKGKFVGGLRLPQDETGDCHMFTQALAARAAELGVQFKFATSIQQLIVEGKHVSGVATSAGLMKADAYVVALGSWSPHLLRPLGISIPVYPVKGYSITVPVADTAAAPVSTVMDESYKVAITRLGKRIRVGGTAEISGYSNTLHAARRATLDHSLTDLFPGGGDLRDTKFWSGLRPMTPDGPPLIGPTPYANLHLNTGHGTLGWTMACGSGRVLADTLSGRKPDVDISELAMTRYETRFG

SEQ ID NO: 333 - DNA, 1110 bp, Unknown; identical to SEQ ID NO: 319
  Obtained from environmental sample

SEQ ID NO: 334 - protein, 369 aa, Unknown; identical to SEQ ID NO: 320
  Obtained from environmental sample
  SIGNAL (1)...(25)
  DOMAIN (9)...(188): 3-hydroxyacyl-CoA dehydrogenase, NAD binding domain
  DOMAIN (190)...(283): 3-hydroxyacyl-CoA dehydrogenase, C-terminal domain
  SITE (122)...(125): N-glycosylation site. Prosite id = PS00001
  SITE (310)...(313): N-glycosylation site. Prosite id = PS00001

SEQ ID NO: 335 - DNA, 1248 bp, Unknown; identical to SEQ ID NO: 321
  Obtained from environmental sample

SEQ ID NO: 336 - protein, 415 aa, Unknown; identical to SEQ ID NO: 322
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001

SEQ ID NO: 337 - DNA, 1248 bp, Unknown
  Obtained from environmental sample
atggcacgtacggacgccatcgttctcggcgcgggcatcgtcggcacctcgatcgcgctgcatctcgtcaaacgaggcttgagcgtcgcgctggtcgatcgcggggggccgggcgaggaaacctcatacggcaacgccggcatcatcgaaggcaacacgcttttcccgcacgcctttccgtccgatccggcggcgctcgcgcgcatcatcttcaagcaggcgacggaagcgaactatcatctctcgtatctgccgaaggcattgccgtggttgctcgcgtaccggaagtggacgcagccggacaagctcgtcgagcatgcgcatatggtgcggccgcttttttcccgcgcggcgcccgagcacgaagcgctgatggcggaatcgaacgctacgcactatttgcgcaaaaccggctggctcaagctttatcgcaccgaacagcatttcgcctcgatgcagcgcgagctcgatctcgcggccaaattcggcctgccggtgaaggcgatcggcaccgacgaggcgcgcgcgctcgagccgtcgctcgcgccggtctttccgcgtgcgatcttctggacggacgcagcgagcgtcagcaatccgctgggcgtcacgcgcgcttatgcggcgcgctacgcggagttcggcggagtgacggtgaaaggcgatgcgctttcgctgcaccggacgggcgaccgctggcgcgtcgagacggatgaaggcccgctcgatgcaggcgatattgtcgtggcgcttgggccttgggcgggcgatttattgcagcgtttcgatctcaagctgccgctcggttacaagcgcggctatcaccggcattttggcgcgcgcggcaatgccggcctgtcgcgaccggtgctcgattcaaccgccggctacctgatcgcgccgatggagcagggcctccgcatcacgagcggcgccgaaatcgccgcgcgcgacgcgccgccgacgcccgtgcaattcgaccggctgctgccgaaggcgcgggagcttttcccgctcggcgatcaggtggacaacaagacgtggatgggcgtgcggccgtgctttgcggattcgcggccggtcatcgggcgcgcgccgaatctgcgcgggctatggcttgccatcggacacgcgcattggggcctgacgctcgggccggcgaccgggcgcatgatcgccgagatgatgacgggcaacacgccgttctgcgatccggcgccataccgtgccgaacgcttccttcagtga

SEQ ID NO: 338 - protein, 415 aa, Unknown
  Obtained from environmental sample
  DOMAIN (5)...(395): FAD dependent oxidoreductase
  SITE (350)...(353): N-glycosylation site. Prosite id = PS00001
  SITE (368)...(380): Lipocalin signature. Prosite id = PS00213
MARTDAIVLGAGIVGTSIALHLVKRGLSVALVDRGGPGEETSYGNAGIIEGNTLFPHAFPSDPAALARIIFKQATEANYHLSYLPKALPWLLAYRKWTQPDKLVEHAHMVRPLFSRAAPEHEALMAESNATHYLRKTGWLKLYRTEQHFASMQRELDLAAKFGLPVKAIGTDEARALEPSLAPVFPRAIFWTDAASVSNPLGVTRAYAARYAEFGGVTVKGDALSLHRTGDRWRVETDEGPLDAGDIVVALGPWAGDLLQRFDLKLPLGYKRGYHRHFGARGNAGLSRPVLDSTAGYLIAPMEQGLRITSGAEIAARDAPPTPVQFDRLLPKARELFPLGDQVDNKTWMGVRPCFADSRPVIGRAPNLRGLWLAIGHAHWGLTLGPATGRMIAEMMTGNTPFCDPAPYRAERFLQ

SEQ ID NO: 339 - DNA, 1245 bp, Unknown
  Obtained from environmental sample
atggctaaaataataattatcggcggtggtattattggattaagttctgcttattatctcaaacgttcgggctgggatgtcactgttctcgacaaaagcgatttttcagacaactgctcttatggcaacatgggttacgtttgtccaagtcattttattccgttagcagcaccgggtattgtaaaacaaggattcaaatggatgtggaactcgcagagtcctttctacgttcagccgaggttgaatggtgcattaattaactgggggatgaaatttattcgcagcgcatccaaaaaaaatgtggaagaatctgccataccacttcgtgatattgctttgcttagtcagcaggaatatgtagaatggaaaaaggaatttgatttttcttacgagcacaaagggttgttggagatatttcagacagaggcaaaggctgagcatgcaaagcatacggttgaaaaagcaaaagagcttggtttggatactgaattgctttcttataatgagctgcagcaattggagccgcatacaaccatcaatgcccttggcgccatcatttttaaatgcgatgcacatttgtttcccgataaactgatgaaagggttaatcgataaattaaaacaatcgggagttgaactgaaacctaatgaagaagtaataaaatttgaaaagaatggaaaggcagtttcaaagattatcacacaaaataaaacatatgaggtagataaggttgtaatagcggccggtgcatggagtcgcgagttaacctcaatgataaatatcaatcttccattgatcccgggtcgtggatattcggttacattggaaaattctccctacaaagtcaattatcctgctgtattgatggaaggaagaacggcgatcacaccgatggatggaaataagatacggttcggcggaacaatggaaattacttctgtcaacaagcccccaagggtaaaccgggtaagaggcattttgaatgcggtcaaacgtttttatcccgagtttgatgtaccaatgccagccgaagacaaaatatggtatggctatcgtccctgttcggcggatggattgccttatatcggtaaagtaaagaaattgaataacgtggtcatagcaacaggtcattcaatgcttggattaagtttgggtgcgggtactggtaagctggtgagcgagatcattaatgaaacacgggtgagtatggatatcaccccatttaatgttgaacgttttggataa

SEQ ID NO: 340 - protein, 414 aa, Unknown
  Obtained from environmental sample
  DOMAIN (3)...(395): FAD dependent oxidoreductase
  SITE (38)...(41): N-glycosylation site. Prosite id = PS00001
  SITE (239)...(242): N-glycosylation site. Prosite id = PS00001
  SITE (403)...(406): N-glycosylation site. Prosite id = PS00001
MAKIIIIGGGIIGLSSAYYLKRSGWDVTVLDKSDFSDNCSYGNMGYVCPSHFIPLAAPGIVKQGFKWMWNSQSPFYVQPRLNGALINWGMKFIRSASKKNVEESAIPLRDIALLSQQEYVEWKKEFDFSYEHKGLLEIFQTEAKAEHAKHTVEKAKELGLDTELLSYNELQQLEPHTTINALGAIIFKCDAHLFPDKLMKGLIDKLKQSGVELKPNEEVIKFEKNGKAVSKIITQNKTYEVDKVVIAAGAWSRELTSMININLPLIPGRGYSVTLENSPYKVNYPAVLMEGRTAITPMDGNKIRFGGTMEITSVNKPPRVNRVRGILNAVKRFYPEFDVPMPAEDKIWYGYRPCSADGLPYIGKVKKLNNVVIATGHSMLGLSLGAGTGKLVSEIINETRVSMDITPFNVERFG

SEQ ID NO: 341 - DNA, 1248 bp, Unknown
  Obtained from environmental sample
atgaagttcgacactattgtgctgggcgcgggcatcgtaggggtatcgattgcagtgcatttgcaaaagctcggccgctcggtcgcgctcgtggatcgcaagcgtcccggcctcgagacatcgtttggaaatgccggactgctgcagcgcgaaggggtgtatccgtacgcgcttcctcgcgacatcagcacgtggatgcattacgcaaagaatgactccatcgatgtccattaccaccgcgacgcgcttcccgcgcttgcgccgttcctctgggcgtactggcgcaactcggaacccgcgaagcacgcggccatcgcgcgtcaatacgcaacgctgatcgaacattgcgtgaccgagcatgaggtcctcgcgcgcgaggcgggcgtcacggctttgctcaagccaacgggctggatcaaggtcttccacaccaacgccgcacaggacgatgaggcgcgcgatgcagaacgctggcatcgtgaattcggtgtgcattacacgctgctcgatcctgccacgttgcagaagaccgagccgcatctggacccatcgctggtgggcggattgcattacacggacgcggtatcggtcaatgatccgggcgcgctggtcgcgggttatgccgcgtatttcgagcggctgggcggacgtttcttcaacggcgacgcgaccacccttgccgaagatggcaacggctggcgcgtgatgacgcaggaagggcaggtcaacgcatcgactgcagtgatcgcgctggggccatgggcgaaggacgtgaccgcggcgctgggatatcggttgccgctcgcggtcaagcgcggctatcacatgcactacacgccgcagccgggcacggtgctgaaccatccggtactcgatgtcgacaacggtttcctgcttgcgccaatggcgcgcggcatccgcctgacgacaggcgtggagctggccgaacgcgatgcgccgaagacacccgtgcaactgctgcgcgccgagcctgtggcgcggactctgttcccgctcggggagcgtgtagacgatgaaccctggatgggccgccgtccgtgcacgcctgacatgatgccgatcatcggacctgcgccgcgtcacaagaacatgtggttcgcattcggccacgcgcatcatgggctcacgctcggcgcggtgacgggcaggctgattgcatccatgatgacgggtgaagaaccgttcatcgataccacgccgttcagggcagaccgctttgcggcttag

SEQ ID NO: 342 - protein, 415 aa, Unknown
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001
MKFDTIVLGAGIVGVSIAVHLQKLGRSVALVDRKRPGLETSFGNAGLLQREGVYPYALPRDISTWMHYAKNDSIDVHYHRDALPALAPFLWAYWRNSEPAKHAAIARQYATLIEHCVTEHEVLAREAGVTALLKPTGWIKVFHTNAAQDDEARDAERWHREFGVHYTLLDPATLQKTEPHLDPSLVGGLHYTDAVSVNDPGALVAGYAAYFERLGGRFFNGDATTLAEDGNGWRVMTQEGQVNASTAVIALGPWAKDVTAALGYRLPLAVKRGYHMHYTPQPGTVLNHPVLDVDNGFLLAPMARGIRLTTGVELAERDAPKTPVQLLRAEPVARTLFPLGERVDDEPWMGRRPCTPDMMPIIGPAPRHKNMWFAFGHAHHGLTLGAVTGRLIASMMTGEEPFIDTTPFRADRFAA

SEQ ID NO: 343 - DNA, 693 bp, Unknown
  Obtained from environmental sample
atggaaaccgtattgatcacaggcgccaatcgcggcatcggtctcgaactcgccgcgcgctacgccgccgccggcaatcgcgtgctggcgtgctgccgcgatccgaagaaagccgaccagctgcaagcgctcgcgaagtcgcgcaaaggtctcaccgtgcacggcgtacacgtcgccgacggcaaatcggtcgccgcactcgcggccgacgtgaaggagccgatcgacatcttgatcaacaacgccggcatgccgggtcccgcggcagacaagcaatcggtcgccaacatggacttcgacggctgggccgagacgttcgccgtcaacacgatggcaccgctgcggatgctgcaagcgtttcgccgcaacttgaaagccggcaagaacgcgcgcgccattacgatcaccagccaaatgggcgcgctatcgctcaacatgccggtgatgttcgcgtactgctcgtcgaaggcggccgtcaacaaggtgatgaacatggcgtcggtcgaactcgcgaacgacggcatcaccgtcggcctgattcatcccggttgggtccgcaccgacatgggcggcaagaacgccgacttgagcgtcgaggacagcgccgcggggatcatggcgacgatcgccaaatggacgcccgccgagaccggctcgttcaagaaatggaacggcgaaacgcacggctggtaa

SEQ ID NO: 344 - protein, 230 aa, Unknown
  Obtained from environmental sample
  DOMAIN (2)...(171): short chain dehydrogenase
METVLITGANRGIGLELAARYAAAGNRVLACCRDPKKADQLQALAKSRKGLTVHGVHVADGKSVAALAADVKEPIDILINNAGMPGPAADKQSVANMDFDGWAETFAVNTMAPLRMLQAFRRNLKAGKNARAITITSQMGALSLNMPVMFAYCSSKAAVNKVMNMASVELANDGITVGLIHPGWVRTDMGGKNADLSVEDSAAGIMATIAKWTPAETGSFKKWNGETHGW

SEQ ID NO: 345 - DNA, 1260 bp, Unknown
  Obtained from environmental sample
atgcgcgcgctcgtcctcggtagcggactcgccggcgtcacggcggcgtactacctgcgcaagaacggtctcgacgtcaccgtcgtcgatcgcgcggcggggccggggcgcgagacgagtttcgcgaacggctccatgatcacgccgagcctcgccgacccgtggaattcgccgggcgtgctcggcgtgttgctgcgttcgctcgggcgcgaggactcgccgatgttgttgcggccgtcggtgttgccgtcgctgttcggttggggcatcgcgtttctgcggaactcctcgcaacgcaatttcgaacgcaactatctgcgcaacgtcgcgctggtccactactcgcaatggatcatgcgcgatctgctgcagacgcatccgctcgcgttcgaccacgcgtacgacggcacggtgaagatctttcgcgatccgcgcgcgttcgactacggcatcaaggtcgcgcatttcctgaagcaatccggcgtgcagcatcggccgctcgaccgcgccgcgctgctcgaaacggaacccgagctgcgctcggtcatcgacgagatctgcggcggcatcgcgtatcccggcgacgagaccggcaacgcgcgactcttctgcgaagaactgcgtcgcgtatgcgccgccgacggcgtgacgttccgcttcgccgaaaacgtcgtcgacatcgagacctggcgcaagcgcgtggcgggcctgcgcaccgcaaaggaaacgttggtggccgacgtgtatgtcctcgccgcgggcagcttcagcgcgacgtgggcgaaacacctcggtttcgacctgccggtgcggccggcgaagggctattcgatcagcgtgccgatgcatcgatgggagcgtcgcccgcgcgtaccgatcgtcgacgattcgttgcacgcagcgctggtaccggtcggcggcgtgttgcgcgtcgccggtaccgccgagttcgcgggttacgacacgacggtgcggccggaacgcatcgacaacctgcgcgggctgctgcggcgcgtgtatccgcagttcgccgagtccgccgatagcgtcgacattcaaccgtggtgcggcctgcggccgctgacgccggacggcatgccgatcgtgggccgcacgccgctcgagaatctctacgtcaacacgggccacggtccgctcggttggtcgatggcctgcggctcgggtaaggcggtcgccgacattgcggcgggtcacgcggccgacctcgacatgactccgttcgcgctgacgcgtttctga

SEQ ID NO: 346 - protein, 419 aa, Unknown
  Obtained from environmental sample
  DOMAIN (2)...(401): FAD dependent oxidoreductase
  SITE (43)...(46): N-glycosylation site. Prosite id = PS00001
  SITE (96)...(99): N-glycosylation site. Prosite id = PS00001
MRALVLGSGLAGVTAAYYLRKNGLDVTVVDRAAGPGRETSFANGSMITPSLADPWNSPGVLGVLLRSLGREDSPMLLRPSVLPSLFGWGIAFLRNSSQRNFERNYLRNVALVHYSQWIMRDLLQTHPLAFDHAYDGTVKIFRDPRAFDYGIKVAHFLKQSGVQHRPLDRAALLETEPELRSVIDEICGGIAYPGDETGNARLFCEELRRVCAADGVTFRFAENVVDIETWRKRVAGLRTAKETLVADVYVLAAGSFSATWAKHLGFDLPVRPAKGYSISVPMHRWERRPRVPIVDDSLHAALVPVGGVLRVAGTAEFAGYDTTVRPERIDNLRGLLRRVYPQFAESADSVDIQPWCGLRPLTPDGMPIVGRTPLENLYVNTGHGPLGWSMACGSGKAVADIAAGHAADLDMTPFALTRF

SEQ ID NO: 347 - DNA, 1245 bp, Unknown
  Obtained from environmental sample
atgcgtactgacgtagtcgtcctcggcgctggcattgtcggcatctgtgtcgcgctgcacctgcagaagcgcgggcgttcggtcgtgctggtcgaccggcggggcgcggccgaggagacctcgttcgggaacgccgggctgatccagcgcgagggggtctatccgtacggctttccgcacgacttcggcgcgttgctgcgctacggcctgaaccggaccatcgacgcctattaccacccgaccgcgctgccgagcctcgctccgttcctgctcaagtactggcgctactcgcgtcccgcccggcacgcgcaggtggcgcgctcctactcgaagctgatcgagcactgcgtgaccgagcacgaggcgctcgccgccgaggcgggcgcggacggcttcctgcaccgcaagggctggctgaaggtgttccgcaccgagcgcgagcgtgaccggcgcttcgccgaggccgagcgctggcgcgaggagttcggcatcaaccaccgcgccatcgaggcgcgccagctccaggagatggagccgcacgtggcgccggtcctggtgggcgcgctgcactggaccgatccggtcagcgtcgacgacccgcacggcctggcgctcgcctacctcgcgctgttcgagcgcctgggcgggaagttcgtgcagggcaacgcctccagcctggaatcccaggaagaaggctggcgcatgcgtacagtggaagggccgattgcgatgaaaggcgtagtggtggcgctcgggccctgggccgacgtgctcactaaagccctcggctatgacttcccgctcgcggtgaagcgcggctaccacatgcactaccgggcggccggaaccgcgaggctgaactacccgatgctcgacaccgagcgcggctacttcctcgcgcccatgcgccgcggcatccgcctcaccaccggcgcggagttcgcgctgcgcgacgcgatccgcacgccggtgcagctcggccgcgccgagccgatcgcgcgcgacctctttcccctcgccgagcgcctggacaccgaggcgtggatgggcgcgcggccctgcacgccggacatgctgccggtgatcggcgccgcgccgcgccaccgcaacctcttcttcgccttcggccacgcgcaccacggcctgacgctcggcgcggtgaccggaaggctggtcgcggagatgatgaccggcgaggcgccgctggtcgatcccgccccgtattctccggagcgcttcgcgtga

SEQ ID NO: 348 - protein, 414 aa, Unknown
  Obtained from environmental sample
  DOMAIN (4)...(395): FAD dependent oxidoreductase
  SITE (72)...(75): N-glycosylation site. Prosite id = PS00001
  SITE (225)...(228): N-glycosylation site. Prosite id = PS00001
MRTDVVVLGAGIVGICVALHLQKRGRSVVLVDRRGAAEETSFGNAGLIQREGVYPYGFPHDFGALLRYGLNRTIDAYYHPTALPSLAPFLLKYWRYSRPARHAQVARSYSKLIEHCVTEHEALAAEAGADGFLHRKGWLKVFRTERERDRRFAEAERWREEFGINHRAIEARQLQEMEPHVAPVLVGALHWTDPVSVDDPHGLALAYLALFERLGGKFVQGNASSLESQEEGWRMRTVEGPIAMKGVVVALGPWADVLTKALGYDFPLAVKRGYHMHYRAAGTARLNYPMLDTERGYFLAPMRRGIRLTTGAEFALRDAIRTPVQLGRAEPIARDLFPLAERLDTEAWMGARPCTPDMLPVIGAAPRHRNLFFAFGHAHHGLTLGAVTGRLVAEMMTGEAPLVDPAPYSPERFA

SEQ ID NO: 349 - DNA, 1251 bp, Unknown
  Obtained from environmental sample
gtgggtgtggcacgtactgatgtaatggttcttggtgccggcattgtcggcacatcggtggcgctgcatctcgcaaaacgcggactcagtgttgccttggtcgatcgcgcggggattggcgagcagacatcctatggcaacgccggtatcatcgaaggcaatacggtatttcctccagcgtttccttcgcattttgacgcgctgctgcgcgtcgcgcttaagcgtgccagcgaggccaactatcatttgtcattcttgccgcacgtcctgccatggttattggcgttccgcgccgcctcgcgaccggatcgccttgtggagacagcccggctgatccgccctttgttttctcatgcggtggccgagcacgaggcgctgatggccgagagcagcgctacccactacctgcgcaaaaccggctggctcaaagtttatcgtaacgaaaggagttttaaggggctggcggctgagttcgacctcgcggcgaaatttggcttgccgctgaatgcactcgacaccgagggagcacaggccctcgagccgtcactcaattcggtatttgccaaagcggtgttctggccagaagcggcgagcatcagcaatcccctcggcgtgaccaaagcctatgcgtcgcgctttgccgcgctgggaggtgtgctcgtggcgggggatgcgcgatcgctccaccggacgggtaatcgctggcgggtggacaccgcggaaggcgcgcttgatgcccaggagtgcgtggtcgcactcgggccttgggctacagacttgcttgatgcgctcggtctgcgattgccgctcgcagttaagcggggctaccaccggcactttcggtcccagggaaatgcgagcctgtcgcgtccggtgctcgacgccgacgtcggctatctgattaccccaatggagcaggggatgcgcataaccaccggtgcggagtttgcgccgcgcgatgcggctcccactccggtacagtttcttcgcatcatgccgcgggcgcgtgagctgtaccctttgggagagcaggtcgacgggcgaacatggctgggcagccggccgtgctttcccgattcccggcccgtcatcgatcgggcgcccggacacgccgggctgtggctcgccatcggtcacgcccactgggggctcacactcggccccgccaccggacgcatgattgcgcagatgatggccggtgagttgccgttttgcgatccggcgccttaccgcgcggagcgatttaactag

SEQ ID NO: 350 - protein, 416 aa, Unknown
  Obtained from environmental sample
  DOMAIN (7)...(397): FAD dependent oxidoreductase
  SITE (289)...(292): N-glycosylation site. Prosite id = PS00001
MGVARTDVMVLGAGIVGTSVALHLAKRGLSVALVDRAGIGEQTSYGNAGIIEGNTVFPPAFPSHFDALLRVALKRASEANYHLSFLPHVLPWLLAFRAASRPDRLVETARLIRPLFSHAVAEHEALMAESSATHYLRKTGWLKVYRNERSFKGLAAEFDLAAKFGLPLNALDTEGAQALEPSLNSVFAKAVFWPEAASISNPLGVTKAYASRFAALGGVLVAGDARSLHRTGNRWRVDTAEGALDAQECVVALGPWATDLLDALGLRLPLAVKRGYHRHFRSQGNASLSRPVLDADVGYLITPMEQGMRITTGAEFAPRDAAPTPVQFLRIMPRARELYPLGEQVDGRTWLGSRPCFPDSRPVIDRAPGHAGLWLAIGHAHWGLTLGPATGRMIAQMMAGELPFCDPAPYRAERFN

SEQ ID NO: 351 - DNA, 1260 bp, Unknown
  Obtained from environmental sample
atgtcttcgactgcgaagcctgacatcatcgttgttggatccggcatcatcggcattgcgtgcgcacattacctaagtgggtctggtctgcgagtgactgtgatcgatcaaggaacgatcggcggcgcgtgttcgcacggcaactgcggctacatctgtccgagtcatgtgttgcccctgacggaaccgggagcgatcggcactgcgctgaaatcactctttaatccgaaagctccatttcgagtgaagccccgactgagccccgccctggtgaagtggatgtggcaatttgccaggcgatgcaatcatcgtcaactgttggccgccgggcagcatctcaaagcgattctggattcttcgatgctggagtacaaacatctgatgcacgaagaaggcctgccgtgtgaatggaaagagatcggcctgttgtacgttctgcaaacggagcacggcatggaggacttcgcgaagaacgatcggctgctgactgagcatttcgggttatcggcacgaagaattgaaggacgcgatctggccgcgtttgatccagcattgcggcctggtctggccggagcctttcattacccgaacgacgcgacgattcgtcccgacttgctcaatgcgagttggtcgcagcggctcaaagaacgtggagtgaccttcatcgagcattgccagttgcagcgcgtcgagaagtcgaaaggccgggttgttcaactcgccacttcgcaagggacattgcaagcggaacgcatcgtgatcgcgaccggagcatggagttcaaaactctcatccgatctggaatgcccgatcccgatcgagcccggcaaaggatactcagtaacgatgcaacggcccgatccatgcccacgcaatccgatgctgtttcccgagcatcgcgtcgcagtttcaccttttgagcacggttatcgcctcggctcaatgatggagttcgcaggcttcgacgaatccattcccgcacggcgcatccaacagttgcaggactcggcatcgcattacctcgcttcatcaacaccgcccggtgagcttcagagctggtacggctggcgcccaatgacctgggatagtttgcccattatcggccgaaccccgcgactcgagaacgtctacctcgcgaccggccacaacatgctgggcatgagcctcgcaacggcgtcgggcaaactggtcgccgagctgatatccggccgcacgccgcatctcgatcccgccgcattctcgccgcagcgatttctttag

SEQ ID NO: 352 - protein, 419 aa, Unknown
  Obtained from environmental sample
  DOMAIN (8)...(400): FAD dependent oxidoreductase
  SITE (210)...(213): N-glycosylation site. Prosite id = PS00001
MSSTAKPDIIVVGSGIIGIACAHYLSGSGLRVTVIDQGTIGGACSHGNCGYICPSHVLPLTEPGAIGTALKSLFNPKAPFRVKPRLSPALVKWMWQFARRCNHRQLLAAGQHLKAILDSSMLEYKHLMHEEGLPCEWKEIGLLYVLQTEHGMEDFAKNDRLLTEHFGLSARRIEGRDLAAFDPALRPGLAGAFHYPNDATIRPDLLNASWSQRLKERGVTFIEHCQLQRVEKSKGRVVQLATSQGTLQAERIVIATGAWSSKLSSDLECPIPIEPGKGYSVTMQRPDPCPRNPMLFPEHRVAVSPFEHGYRLGSMMEFAGFDESIPARRIQQLQDSASHYLASSTPPGELQSWYGWRPMTWDSLPIIGRTPRLENVYLATGHNMLGMSLATASGKLVAELISGRTPHLDPAAFSPQRFL

SEQ ID NO: 353 - DNA, 1263 bp, Unknown
  Obtained from environmental sample
atgcgccaatcccgttcggtcatcatctgcggcggcggcgtcatcggcctgagctgtgcctattacctggcccgcgagggctggcgggtcacgctcgtggagcgcaacgccgagggcgccgactcctgcgcgcacggcagcgccggctatgtctcgccgagccacgtggagccaatctcggcgcctggcatggtgtggaaggggctcaagtggatgatgagttcgcggagcccgttttatatcaagccgcgactcgacagcgacctgatccgctggggctggctcttcgcccggcattgcaccgagcaacaccggcgccggtccgccccggtgttgcgcgacctgtgcctcggtgggcggaagcttttcctggaactgtcggacatcaccggcgattccttcgagctgaagcaggaggggctgatgaacctctgccagacccaggagacgctcgacaaatacacccacggtctcgccgcgctgtgcaacgaggtcggcgtcgaggcgcgcacgctgaacgcgcagcaggcgcaggcgctcgagccgggcgtgaagatgaaggtggccggggcgatttatttccccatcgatgcacacctctcgccgcggctgttcgtcccggcgctgaccgcgctgctcaaggacatgggcgtgaagttctgctggaacacgagtgtctatggctggcgctccgagggcggccgcgtcacggccgtgtccacgacggccggtgacctcatcgccgacgaatacgtgctggccggcggctcctggtcgccgtcgatggtccacggcctgggcatcaggcttccgatgcaggcgggcaagggttacagcctgacgatggaccggccgcggtttcacctgaccaaaccgatgatcctgacggagcgccgcgtggcggcgacaccgatgggggacaaactgcgctttggcggcacgatggagatcgccggccacagcgacaacgtcaggcctgagcgcgtccagcagatcaaggacggcgcgcgcgccttcttccccgagatcaccgaggcggatttcgacggcatcaagccgtggttcggctaccggccggtctcgcccgacggcatgccctacatcgggcggctggggcgttatgcgaatctttccaccgccagcgggcacgcgatgctcgggttgacgctggcgccgatctcaggcttgctcattgccgaggtgctgacgggcaagaagccatcggtggacctttcgctgctcaatcccaaccgcttcgcgtga

SEQ ID NO: 354 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
  SITE (381)...(384): N-glycosylation site. Prosite id = PS00001
MRQSRSVIICGGGVIGLSCAYYLAREGWRVTLVERNAEGADSCAHGSAGYVSPSHVEPISAPGMVWKGLKWMMSSRSPFYIKPRLDSDLIRWGWLFARHCTEQHRRRSAPVLRDLCLGGRKLFLELSDITGDSFELKQEGLMNLCQTQETLDKYTHGLAALCNEVGVEARTLNAQQAQALEPGVKMKVAGAIYFPIDAHLSPRLFVPALTALLKDMGVKFCWNTSVYGWRSEGGRVTAVSTTAGDLIADEYVLAGGSWSPSMVHGLGIRLPMQAGKGYSLTMDRPRFHLTKPMILTERRVAATPMGDKLRFGGTMEIAGHSDNVRPERVQQIKDGARAFFPEITEADFDGIKPWFGYRPVSPDGMPYIGRLGRYANLSTASGHAMLGLTLAPISGLLIAEVLTGKKPSVDLSLLNPNRFA

SEQ ID NO: 355 - DNA, 1017 bp, Unknown
  Obtained from environmental sample
atgaaacccgacggcggctccctcatcggcttcggttccagcggcctcggcggcgccactttcaaggcgttcgatcccgcaaaaaatgtcgccctcgagccgacctttctctcggccgtcaccgaggacgtcgagcgcgccgtccagctggccgtcgccgccgcgccggtctgggccaagctgtcgggaacggagcggaacaagtttctcatttcgatcgcggacaagcttgaggccaagtcggccgacctcgtggcccgggccatgcaggagaccggcctgcccgaggcgcgcctcaagggcgaggtgacccgcaccgcgggccagctgaaactttacggcgagacggcgcagcgcggcgactggctcgatgcccgcatcgagacggcgttgcccgaccgcaagccactgcccaagcccgaccaccgttcgatgctccgcgcgatcggcccggtggtcgtgttcggctcgagtaattttcccttcgcctactcggtggcgggcggcgacgtggcctcggccttcgcggccggttgcccggtcattgtcaaggcccacccggcgcatcccggcacgagtgagatggtcggccggctgatcctccacgccgtgcgcgagtgtggcctgcccgaaggcacgttctcgctgttattcgacgccggctttgaggtcggccaggcgctggtgcagcaccctgaggtgaaggccgtgggtttcacgggctcggtcaagggtgggcgggcgctcaccgatctcgccgcggcccggcccgagccgattccggtctatgccgagatgggcagcgtcaaccccgtcttcatcctgcccggcgccatcgccgagcgtgcagcgggcatggtcgagggcctgtatgcctcgtccaccgttggtgtcggccagttctgcaccaatcccggcctgatcgtgctgcagcgttcggcggcggcggagcagttcatcaaggacatggccgcccgcctcagcgcgacgctcgagggcgtgatgctcacgcccggg

SEQ ID NO: 356 - protein, 339 aa, Unknown
  Obtained from environmental sample
  DOMAIN (11)...(339): Aldehyde dehydrogenase family
MKPDGGSLIGFGSSGLGGATFKAFDPAKNVALEPTFLSAVTEDVERAVQLAVAAAPVWAKLSGTERNKFLISIADKLEAKSADLVARAMQETGLPEARLKGEVTRTAGQLKLYGETAQRGDWLDARIETALPDRKPLPKPDHRSMLRAIGPVVVFGSSNFPFAYSVAGGDVASAFAAGCPVIVKAHPAHPGTSEMVGRLILHAVRECGLPEGTFSLLFDAGFEVGQALVQHPEVKAVGFTGSVKGGRALTDLAAARPEPIPVYAEMGSVNPVFILPGAIAERAAGMVEGLYASSTVGVGQFCTNPGLIVLQRSAAAEQFIKDMAARLSATLEGVMLTPG

SEQ ID NO: 357 - DNA, 1251 bp, Unknown
  Obtained from environmental sample
atgaaaaatgtaatagtagtaggaggcggtataatcggtttaagcagtgctttgtatttgcaacgttcggggcataacgttactgttattgataaagataattttacagataactgttcgtatggtaatcttggttatgtatgcccgagccattttatacccttggcagcaccgggtattgtgtggcagggaattaaatggatgttcaacagccgcagccctttttatgtgcaaccatcgttgaatctctctttaatagactggggattaaagttcatgcgcagcgccactcaaaaaaatgttgatgaagcggctactccattaaaggatatagctgtatttagtcaacaggaatataaggagtgggaaaaaatggaaggctttgagttcgcttatgaacataagggtatgctggaaattttcaaaacggagaaggtcgcacatcatgcagcgcatacagttgaaacgggaaaaaaacttgggttagatgttgagctgctagatgcaaaaggcttacagcaactggaaccgcaaacaaccatcaatgcattaggcgctattaactttaagtgtgatgcacatttatatcctgataaattaatggcctcattaaaaaaatatttgccgcaaaagggtgtgcaattaatacatgatgaagtaacaggatttgaaaaaagcagcaacaagataactaaagtgctttgtaagagtaataattacaatacagatgaagttgttgtcgctacgggttcatggagccgggaagtagctgctatgcttgataccaaaattccattgatgcccgggcgtggttattccttcacgttagataatccagaatataaattgaaccatccggcaattcttgccgaaggaagagttgctattacaccatttgagaatggcaataaaatgcgttatggcggtactatggaagtagtgaacacaaaagcgccgccacgctatcatcgcgtagaaggcattataaatgctgttaaagattttttacctgactttaaacttgaaatgcctgcacaggataaaatatggtatggttacaggcccacatctgcagacggattgccctacatcggccgtgtacagaaatataaaaatgtaactgtagcaacaggccatgcgatgttaggattgagtttgggcgcaggcaccggcaaattagtaagtgaactgattaatgaaacaaaaccaggcgtagagctaaaagcttttgatgtagaaaggtttggatag

SEQ ID NO: 358 - protein, 416 aa, Unknown
  Obtained from environmental sample
  DOMAIN (3)...(397): FAD dependent oxidoreductase
  SITE (26)...(29): N-glycosylation site. Prosite id = PS00001
  SITE (34)...(37): N-glycosylation site. Prosite id = PS00001
  SITE (38)...(41): N-glycosylation site. Prosite id = PS00001
  SITE (83)...(86): N-glycosylation site. Prosite id = PS00001
  SITE (377)...(380): N-glycosylation site. Prosite id = PS00001
  SITE (405)...(408): N-glycosylation site. Prosite id = PS00001
MKNVIVVGGGIIGLSSALYLQRSGHNVTVIDKDNFTDNCSYGNLGYVCPSHFIPLAAPGIVWQGIKWMFNSRSPFYVQPSLNLSLIDWGLKFMRSATQKNVDEAATPLKDIAVFSQQEYKEWEKMEGFEFAYEHKGMLEIFKTEKVAHHAAHTVETGKKLGLDVELLDAKGLQQLEPQTTINALGAINFKCDAHLYPDKLMASLKKYLPQKGVQLIHDEVTGFEKSSNKITKVLCKSNNYNTDEVVVATGSWSREVAAMLDTKIPLMPGRGYSFTLDNPEYKLNHPAILAEGRVAITPFENGNKMRYGGTMEVVNTKAPPRYHRVEGIINAVKDFLPDFKLEMPAQDKIWYGYRPTSADGLPYIGRVQKYKNVTVATGHAMLGLSLGAGTGKLVSELINETKPGVELKAFDVERFG

SEQ ID NO: 359 - DNA, 1251 bp, Rhodococcus ruber DSMZ 44319
atgtcggttcgtcggacggtggtcgtcggtgcggggatcgtgggcctgtccactgcgtggttcctgcaggaacgcggtatcgaggtcacggtgctcgatcgggtcggtgtggcgggcgacgcatcgtggggcaacgccgggtggctcgcgccggcgctgaccctgccgctgcccgagccgggggtgctgcgctacgggttgcgctcgatgttccggccgtcctcgccggtgtacgtgccgcccacgacggatctgcggttgctgcgcttcctcgccgacttcgcgcggcactgcacgagacggaaatggacgtcgtcgatggaggtcttcgcgcgcgccaaccgcgtcgccctcgacgcctacgacgatctcgcccgcgggtcgggcgacacgatcgtcaccgagccgacgcgggtcgccgatccgttcctcgcggcgttcacctcggacgacgatcgacggctgctggtcgaggagttcgagcacgcacgtgccgcaggcagcgagatcgatttcgacctgctcgacaccgacacgctgcattcgctcgaaccgctgctcggggacccggtgcgggtcgggctccggatccgggggcagcggttcatcgatccgccgcggttcgtcgcctctctggcgcacgcggtccgcgcccggggcgcggagatcgtcaccgatgtcgacgtccaggaggtgcgcgacaccggtcgcggggtggacgtcgtcgtggccggtggcgactcccgttcggcggatgcggtggtgctcgcgaacggagcgtggctcgggccgctcgcccggccgttcggtgtgcgcacgcaggttcaggccggtcgcggctacagcttcagcgtgcggccgccgagcctgccgaagaacccggtctacttccccgcccagcgggtggcgtgcacacccctccaggaccgcttccgggtcgccggcatgatggagttccgcagccccgacgccccgctcgacccgcggcgcatcgaggcgatcgtcgacgcgacccgaccgctgctgcgcgatgtcgactgggacgggcgcagcgaggagtgggtgggctcgcgtccgtgcacggcggacgggctcccgctgatcggccgcacgcgttcggagcgggtgtacgtcgccggcgggcacgggatgtggggtgtggcgctcggtcccctcaccggacggctgctcgccgggtcgatgaccggcgagccggatccgttgctcaggtcgttcgatccgctgcgctga

SEQ ID NO: 360 - protein, 416 aa, Rhodococcus ruber DSMZ 44319
  DOMAIN (5)...(400): FAD dependent oxidoreductase
MSVRRTVVVGAGIVGLSTAWFLQERGIEVTVLDRVGVAGDASWGNAGWLAPALTLPLPEPGVLRYGLRSMFRPSSPVYVPPTTDLRLLRFLADFARHCTRRKWTSSMEVFARANRVALDAYDDLARGSGDTIVTEPTRVADPFLAAFTSDDDRRLLVEEFEHARAAGSEIDFDLLDTDTLHSLEPLLGDPVRVGLRIRGQRFIDPPRFVASLAHAVRARGAEIVTDVDVQEVRDTGRGVDVVVAGGDSRSADAVVLANGAWLGPLARPFGVRTQVQAGRGYSFSVRPPSLPKNPVYFPAQRVACTPLQDRFRVAGMMEFRSPDAPLDPRRIEAIVDATRPLLRDVDWDGRSEEWVGSRPCTADGLPLIGRTRSERVYVAGGHGMWGVALGPLTGRLLAGSMTGEPDPLLRSFDPLR

SEQ ID NO: 361 - DNA, 1251 bp, Rhodococcus ruber DSMZ 44319; identical to SEQ ID NO: 359

SEQ ID NO: 362 - protein, 416 aa, Rhodococcus ruber DSMZ 44319; identical to SEQ ID NO: 360
  DOMAIN (5)...(400): FAD dependent oxidoreductase

SEQ ID NO: 363 - DNA, 1251 bp, Rhodococcus ruber DSMZ 44319; identical to SEQ ID NO: 359

SEQ ID NO: 364 - protein, 416 aa, Rhodococcus ruber DSMZ 44319; identical to SEQ ID NO: 360
  DOMAIN (5)...(400): FAD dependent oxidoreductase

SEQ ID NO: 365 - DNA, 1266 bp, Unknown
  Obtained from environmental sample
gtgaaagttctgatcctcggcagcggtgtcatcggcgtcacctccgcctactacctcgcccgtgccggccatgaggtgacggtggtcgaccgtcagccggagccggcactggagacctctttcgccaatgccggcgaggtatcgcccggctattcctcgccatgggccggccccggcgtgccggtgaaggcggtcaaatggctgttgatgaagcacggcccgctggtgatccggccgaagctcgatccggtgatgtgggtctggctgctgaagttgctgcgcaactgcaccagcgcgcgctacgcggtcaacaagagccggatgattccgatcgcggaatacagccgcgatgccttgcgcgatctgcgccggcagatcggcatccaatatgacgagcgctcgcagggcaccctgcagctgtttcgctaccaggcccagctcgatggcaccgccgaagatatcgccgtgctcaagcaatacggcgttcccttcgaggtgctgagccgcgagggctgcatcgccgtcgagccggcgctatcaggcgtgaaggagaagttcgtcggcgggctccgcctgccgcaggacgagaccggcgattgccacatgttcacgcagtcgctggccaagcatgcccaggcgctcggcgtccgcttcatgttcaacacctcgatcgatcgcatcgtcaacgagggcgcgcgcgtcagcggcgtcgcgaccagcgccggcctgttgcaggcggacgcttacgtgctggcgctcggcagctggtcgtcgcggctggcggcgccgctcggcatttcgctgccggtctatccggtgaagggctattcgatcacggtgccgatcaaggacgcttccggcgcgccggaatcgaccgtgatggacgagagctacaaggtcgcgatcacccggctcggccatcgcatccgggtcggcggcaccgcggaaatctccggctattcggacaagctctacgatgcgcgccgcgccacgctcgatcattcgctgaccgacctgttcccgcgcggcggcgatctcggcaaggcgacgttctggagcggcctgcgcccgatgacgccggacggcccgcccgtgatcggcccgacgcaatatgccaacctccacctcaacaccggccacggcacgctgggctggaccatgtcctgcggctcgggccgcgtgctcgccgacatgctgtcgggcaggaagccggagatcgacgtgagtgcgctgtcggtggagcgatacaagcaccggttcggctaa

SEQ ID NO: 366 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPVMWVWLLKLLRNCTSARYAVNKSRMIPIAEYSRDALRDLRRQIGIQYDERSQGTLQLFRYQAQLDGTAEDIAVLKQYGVPFEVLSREGCIAVEPALSGVKEKFVGGLRLPQDETGDCHMFTQSLAKHAQALGVRFMFNTSIDRIVNEGARVSGVATSAGLLQADAYVLALGSWSSRLAAPLGISLPVYPVKGYSITVPIKDASGAPESTVMDESYKVAITRLGHRIRVGGTAEISGYSDKLYDARRATLDHSLTDLFPRGGDLGKATFWSGLRPMTPDGPPVIGPTQYANLHLNTGHGTLGWTMSCGSGRVLADMLSGRKPEIDVSALSVERYKHRFG

SEQ ID NO: 367 - DNA, 1317 bp, Unknown
  Obtained from environmental sample
atgaaggtcatagtattgggttcgggcatcatcggcaccgcctccgcctggtttctgaacaaggcgggacacgaggtgactgtcgttgaccgtcagccaggcgcagcgcaggaaaccagctttgccaacggctgccagatttcggtatcgcatgccgagccctggtccaatccatcggcgcctttcaagattctcaagtggctcggcaaggaagatgcgcccctgctgtatcgcttccgggcggaatggctgcaatggaaatggggcctgaactttctgcgcgaatgcacggcctcgcgcaccgcctacaatatccgccagatcgtcgccatcgccgaatacagccgccagacgctgcaagccgtgcgcgccgaaaccgggctggactatgatcatctcacgcgcggcatcctccatttctataccagccagaaggatttcgatgcgtcgctgtcggccgccgctctgatgcgcgagctgggctgcccgcgcgaaaccatcagcgccgacgaggtggtccgcatcgaaccggcgttggccaaggtccgcgacaagatcgtgggcggcgacttcaccgcgaccgatgaatcgggcgatgtttacaaattcacgaccgggcttgccgccaaggctaaagaagccggcgtggatttccggttcgataccatggttacgcgcctgttggccgaaggcgccggcgcatccgcaaaaatcacgggcgtggaagtcatcgatgcacatggccgccatcaggcgctgcacgccgatgcattcgtgctggccatgggaagcttttcagcacctgtcgccaagccgctgggcatcgacctgctgatctatcccggaaagggctattccgccacctatcgggtcattgatcctggcgcggcgccgacggtatcgctgaccgatgatggctacaaactggtggtctcccgtctgggcgaccgcctgcgcgtggcgggaacctgcgaactcaacggctataccagggaactgaaccccattcgctgcgaggcgatcacccgccgcatccgcgaactgtttcccggcgcctgcgactacgataatccggcatattggaccgggttgcgcccgctgacgccatcgaacgtgccgtacatcggcaagaccaggtacggtaatcttttcctcaataccggacatggcacccttggctggaccatgggctgcggctccgggcgcgcaatcgctgaaatcgtgtccggcaagaccccggaagtcgatttcgacttcaccggcatgccgcgccgcccttcccggccgcttacggtttcccgtcctgcccaggcttga

SEQ ID NO: 368 - protein, 438 aa, Unknown
  Obtained from environmental sample
  DOMAIN (2)...(407): FAD dependent oxidoreductase
MKVIVLGSGIIGTASAWFLNKAGHEVTVVDRQPGAAQETSFANGCQISVSHAEPWSNPSAPFKILKWLGKEDAPLLYRFRAEWLQWKWGLNFLRECTASRTAYNIRQIVAIAEYSRQTLQAVRAETGLDYDHLTRGILHFYTSQKDFDASLSAAALMRELGCPRETISADEVVRIEPALAKVRDKIVGGDFTATDESGDVYKFTTGLAAKAKEAGVDFRFDTMVTRLLAEGAGASAKITGVEVIDAHGRHQALHADAFVLAMGSFSAPVAKPLGIDLLIYPGKGYSATYRVIDPGAAPTVSLTDDGYKLVVSRLGDRLRVAGTCELNGYTRELNPIRCEAITRRIRELFPGACDYDNPAYWTGLRPLTPSNVPYIGKTRYGNLFLNTGHGTLGWTMGCGSGRAIAEIVSGKTPEVDFDFTGMPRRPSRPLTVSRPAQA

SEQ ID NO: 369 - DNA, 1245 bp, Unknown
  Obtained from environmental sample
atgaaagtaacgatcataggaggcggcgtagttggtttatgttccgcttattatttaaataaagaaggatacgcggtcaccgttattgatcgcaacgatattaccgatggctgctcgttcggaaacatgggttatatttctcccagccattttattccgttagcatcgcctggcattattagccagggattgaaatggatgctcagctcatcttctccattttatatcaagccaagattaaattgggatcttattcaatggggtctttcgttctggaaaaattctactgagcaaaaagtaaaagaaaatgttccgcctctcaataatttattacagctgagccgtgaattaatgaatgatctgaaaaaagatttcaatgattccttcaccatgatcgaaaaaggttgctggacgctttataaaacacaaaagacggctgatcatgaaaaacatttaacagagcaagcggtaggacttgggttgaaaacaaaaatttgcaccagtgcagaggttcaacagatggagccggaggtggaaacagacgtgatcggaggtgtgctgtggttagatgattgccatttggacacgaggaaatttatgagaacattacatgaacaattagaaaaggcaggagtgaagtttttattgaatacagaagtaaaagggtttgaaagaaccaatggaaacattaatgcagtaattaccaacaaagaaaaaatcgatgcggatgaaattattgttgccaatggttcatggatgcctgaagtagcaaagatggcgggtgttcatttactaatgcaaccgggaaagggttatagtgtggtatatgagaatatggcaaagaatcttcatcatcccgctattttggttgaaggtagaacagcgatgacgcctattggtagatggttaaggatcggaggaactatggagttaagcggacatagtgataatgtcttgccgaagagagtatcggctatttataatgcggtaaaaaaatattttccctcaataaatattccggagccgcaatttgaaaaggcctggtatggttatcgccccgtaacacctgatggacttccttacattgggaagcataaaaaactttccaatataatatttgcaggagggcatgccatgttgggtgtatcagcagctgctgcaactggtaaaattgtaaatgagatcgtaagcaaccggccgacttctattgatgtttctgcatttagaccggaaaggttttcataa

SEQ ID NO: 370 - protein, 414 aa, Unknown
  Obtained from environmental sample
  DOMAIN (2)...(395): FAD dependent oxidoreductase
  SITE (95)...(98): N-glycosylation site. Prosite id = PS00001
  SITE (127)...(130): N-glycosylation site. Prosite id = PS00001
  SITE (252)...(255): N-glycosylation site. Prosite id = PS00001
MKVTIIGGGVVGLCSAYYLNKEGYAVTVIDRNDITDGCSFGNMGYISPSHFIPLASPGIISQGLKWMLSSSSPFYIKPRLNWDLIQWGLSFWKNSTEQKVKENVPPLNNLLQLSRELMNDLKKDFNDSFTMIEKGCWTLYKTQKTADHEKHLTEQAVGLGLKTKICTSAEVQQMEPEVETDVIGGVLWLDDCHLDTRKFMRTLHEQLEKAGVKFLLNTEVKGFERTNGNINAVITNKEKIDADEIIVANGSWMPEVAKMAGVHLLMQPGKGYSVVYENMAKNLHHPAILVEGRTAMTPIGRWLRIGGTMELSGHSDNVLPKRVSAIYNAVKKYFPSINIPEPQFEKAWYGYRPVTPDGLPYIGKHKKLSNIIFAGGHAMLGVSAAAATGKIVNEIVSNRPTSIDVSAFRPERFS

SEQ ID NO: 371 - DNA, 1266 bp, Unknown
  Obtained from environmental sample
gtgaaagttctgatcctcggcagcggtgtcatcggtgtcacctctgcctactacctcgcacgtgctggtcatgaggtgacggttgtcgaccgtcagcccgagccggcgctggagacctctttcgccaatgccggcgaagtctcgcctggctattcctcgccctgggccggccccggcgtaccggtgaaggcggtgaagtggctgctgatgaagcacggtccgctggtgatccggccgaagctagatcctgagatgtgggtctggctgttcaagatgctgcgcaactgcaccagcgcgcgctacgccatcaacaagagccggatgatcccgatcgcggaatacagccgcgatgtcttgcgcgatctgcgccgcgacatcggcattcaatatgacgagcgctcgcaaggaacgctgcagctgttccgttaccaggcccagctcgacggcacggccgaggacatcgccgtgctgaagcaatatggcgtgcccttcgaggtgctgagccgggagggctgcatcgcggccgagccggcgcttgccggcgtgaaggagaagttcgtcggtggacttcgcttgccgcaggacgagaccggcgactgccacatgttcacgcaggcgctggccaagcacgcccaggcgctcggcgtccgcttcatgttcaacaccggcatcgaccgcatcgccaccgacggcgcgcgtgtcagcggtgtcgcgaccagcgccgggatgttgcgggcggacgcgtatgtcctcgcgctcggcagctggtcgtcgcggctggttgcgccgctcgggatctcgttgccggtctatccggtgaagggctattcgatcacggtgccgatcaaggacgcctccggcgcgccggaatcgaccgtaatggacgaaagctacaaggtcgccatcacgcgattgggcgatcgcatccgcgtcggcggcaccgcggaaatctccggctattccgacaagctctacgatgcccgccgcgccacgctcgatcattcgctgaccgacctattcccgcgcggcggcgatcttgccaaggcgacgttctggagcggcctgcgcccgatgacgccggacggcccgccggtgatcggcccgacccaatacgccaatctccacctcaacaccggccacggcacgctcggttggaccatgtcctgcggctccggccgcgtgctcgccgacatgctgtcgggcaagaagccggacatcgacgtcggtgcgctgacggtagatcggtacaagcaccggttcgggtga

SEQ ID NO: 372 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPEMWVWLFKMLRNCTSARYAINKSRMIPIAEYSRDVLRDLRRDIGIQYDERSQGTLQLFRYQAQLDGTAEDIAVLKQYGVPFEVLSREGCIAAEPALAGVKEKFVGGLRLPQDETGDCHMFTQALAKHAQALGVRFMFNTGIDRIATDGARVSGVATSAGMLRADAYVLALGSWSSRLVAPLGISLPVYPVKGYSITVPIKDASGAPESTVMDESYKVAITRLGDRIRVGGTAEISGYSDKLYDARRATLDHSLTDLFPRGGDLAKATFWSGLRPMTPDGPPVIGPTQYANLHLNTGHGTLGWTMSCGSGRVLADMLSGKKPDIDVGALTVDRYKHRFG

SEQ ID NO: 373 - DNA, 1260 bp, Unknown
  Obtained from environmental sample
atgaagccggacgtgatcgtactcggtgccggaatggtcggcgtctcgacggctctccatctccagagccgcggccatgacgtggttctggtcgaccgccgtcctcccggcgaggaaacctcgttcggcaatgccggcgtcatccagcgcgaggccgtggaaccctacgcctttccccggtccgccctgcagctcctgcgtttcgcgtgcaagaccggcccggaggtgaactatcattttcgtgcgctgcccggtctgataggaccgcttctgcggtactggtggttttccgcgcccgcccgctaccccgccattgccgccgcgcatgcaaggctgatagagcactgcctcagcgagcacgaggtgctgatcgggcaggccgcggcggacgatctggtgcggcgcgacggtttccgctttgtctacaggtccgcaagggccctggagaccgacgcggcgcaggcccggcaactggcggccgaccatggccttgcctgcgattttcttgacggcgatgccctggcacgggccgagccggcgctgaaacagccgctggctggcgcgcttcactggcgcgatccctggacggtcagctcgccgggagagcttgtcctccgctatgccgcgctgttccggcggaagggtgggactgtgctgaccggcgatgcggcaagcctgacccggaagggaaattccggctgggcggtgatgacggaggacggcaagctggaagccgccaatgcggtgatcgcgcttggcccctggtcggtggagaccgcaaggcgcctcggataccgactgcctctgttcgtcaagcgcggctatcatcgccactaccggcccccggatggcgccgcgcggctggcactgccgatgctggatgcgcagaagggggtcgtgctggcgcccatggcacaggggctgcggattaccaccggcgccgaattcgcccggctcgaagcgccatcgacgccagtacagatcgaaggtgctgcccgggcggcggccgagttgctggatgtcggcacgccggtcgagccggcaccgtggcgtggcgcacggccatgcaccccggacatgctgccggtggtcggtgccgcgccgcgccacaacggcctgtggttccatttcggtcatgcccatcagggcttcacgctcggccccgtcaccggcaggctcattgcggagatgatcgggggcgagcgccccttcctcgacccgtcaccttatgccgtcacccgctttgccggcgggcgctga

SEQ ID NO: 374 - protein, 419 aa, Unknown
  Obtained from environmental sample
  DOMAIN (4)...(397): FAD dependent oxidoreductase
MKPDVIVLGAGMVGVSTALHLQSRGHDVVLVDRRPPGEETSFGNAGVIQREAVEPYAFPRSALQLLRFACKTGPEVNYHFRALPGLIGPLLRYWWFSAPARYPAIAAAHARLIEHCLSEHEVLIGQAAADDLVRRDGFRFVYRSARALETDAAQARQLAADHGLACDFLDGDALARAEPALKQPLAGALHWRDPWTVSSPGELVLRYAALFRRKGGTVLTGDAASLTRKGNSGWAVMTEDGKLEAANAVIALGPWSVETARRLGYRLPLFVKRGYHRHYRPPDGAARLALPMLDAQKGVVLAPMAQGLRITTGAEFARLEAPSTPVQIEGAARAAAELLDVGTPVEPAPWRGARPCTPDMLPVVGAAPRHNGLWFHFGHAHQGFTLGPVTGRLIAEMIGGERPFLDPSPYAVTRFAGGR

SEQ ID NO: 375 - DNA, 1257 bp, Unknown
  Obtained from environmental sample
atgggtaaacaggttttaattattggcggcggtatcatcggcctcagcagcgctttttatttgcggcaggaaggctttgaggtgaccgtggttgaccagggcgatcttaccaatggctgctcttacggcaacgcaggatacttatgtcccagtcattttgtgcccatggccgcccccggcatcgtggcgcagggattcaaatggatgttcaattcaaaaagcccgttttatgtgcagccccgtttaaacagcgaactgatcagctggggtttgcaattcatgcgcagcgccaataaaacgcatgttgacaattcggctgttcctttacgtgatatcgctttgttgagtaaaggattatatgaagaatggacgaagctgcccgggttcaattttgcctacgatccgagaggcttgctcgacctttttaaaacagaagccaatgcgcatcatggcgagcacgcggtaaaagatgcccgcgcattaggtctcgatgcccgtttgctgaacaagcaggaagtagccgccatgtttcccggcgttcaactcgatattttaggtgccgtttattatggctgcgatgcgcagttgtatcctaacaagctcatggccgacctggtgaattatttaaagcaaaacggtgtacagtttgaattgaataaaactataaccgggtttaccatcgatggctctaccgtagctgcggttcacgctgaagggaaaattttcaaacccgatcatatcgtattagccgccggtgtgtggagcggctccatagccaaacaactgaacatcaaaatacccatggtgggcggcaggggttactcggtgaccttcgaaaatgcgccctggaaatttacctatcccgtgttgctgagcgaggcgcgtgtggccatttccccaatggatggcaataaactccgctttggcggcaccatggaaattaccggcactaaaacacctccacgcctcaatcgtgtgagaggcatactggaagccgtaacaagatatttccccgactataaagtgccgatgccgcctgaaaattcgatctggtatggataccgtccctgcagtgcagatggattgccgtatattggtaatatcagtcgctataaaaaccttacggtgggcaccggccactcgatgctgggactgagcctgggcgcaggaaccggcaaactcgtgagcgaactggtggccggcaaaaaaacagctatggacaccacgccattccgggtagaaagattcgatcgatga

SEQ ID NO: 376 - protein, 418 aa, Unknown
  Obtained from environmental sample
  DOMAIN (4)...(398): FAD dependent oxidoreductase
  SITE (99)...(102): N-glycosylation site. Prosite id = PS00001
  SITE (222)...(225): N-glycosylation site. Prosite id = PS00001
  SITE (372)...(375): N-glycosylation site. Prosite id = PS00001
  SITE (378)...(381): N-glycosylation site. Prosite id = PS00001
MGKQVLIIGGGIIGLSSAFYLRQEGFEVTVVDQGDLTNGCSYGNAGYLCPSHFVPMAAPGIVAQGFKWMFNSKSPFYVQPRLNSELISWGLQFMRSANKTHVDNSAVPLRDIALLSKGLYEEWTKLPGFNFAYDPRGLLDLFKTEANAHHGEHAVKDARALGLDARLLNKQEVAAMFPGVQLDILGAVYYGCDAQLYPNKLMADLVNYLKQNGVQFELNKTITGFTIDGSTVAAVHAEGKIFKPDHIVLAAGVWSGSIAKQLNIKIPMVGGRGYSVTFENAPWKFTYPVLLSEARVAISPMDGNKLRFGGTMEITGTKTPPRLNRVRGILEAVTRYFPDYKVPMPPENSIWYGYRPCSADGLPYIGNISRYKNLTVGTGHSMLGLSLGAGTGKLVSELVAGKKTAMDTTPFRVERFDR

SEQ ID NO: 377 - DNA, 1245 bp, Unknown
  Obtained from environmental sample
atgagtaagaaggtagttgtcattggatctggaatagtaggggcctcgtgcgcttactatttacacaaagccgggcacgaggtggtgcttctggaaaaggagcaacagggctctggggcttcctatgtcaatgcgggctatataactcccagccatattattccactggctgcaccggggatggtccaaatggggatgaagtacttattcgattccagtggtcctttttatatgaaaccccggttcgatttagactttataaagtgggcttgggcctttcaaaaatcctgcaccaaaagcaatgtacaaaaggccattcctttgatcaaggccctgaacattcacagccgggaattgtatgaagagttgttgagttgtggtgatctcggagaattccactgggaggataaaggtcttttgatggtctacaaaacacaaaaggccgccgattccgaaggacttgtggctgaagaggcgcgaagcttgggactggaagtagatcaactggacaccaatcgcctgcgcgaattggaacccggttttggagaggaagttttgggcgcttggcattaccattgcgatcgacacagcacaccaaccgatgtgcttcctcggcttttgaagtatctgcggcaacacattagttttcagaaatcgaagggcgttgatcatatcaaaagcacttcgcttggggtaagcttaaaatgtggccaagaaagccttacggctgatcgcgttgttattgcagctggcgtctggtcttcccaattagcaaaacagttgggacagcgtttgcatttggaagcgggaaaagggtaccgaatcgatgtggagaacgaattgaatattgggatgcccgctatttccttggagcacaaaattgctgttacccctatgaaaggatttacccgattcgcaggaaccatggagttttcgggaatcaacaccaccgttcgtcctgaaagggttgccgctattgccaaagcggcgcaatccctatatgccaatttggatttttcggaacaagacctggcctccgctgcaacaggaatgcggcccgtaagcccggacggactgccttatattggaccgatggcggatcaccccaatatctatttggccacggggcatgccatgatgggttggagcctagggccagtaacgggccatatgattgcagatatgatttctgagcgcacaccggtcttggattcacctcacctgcgtgttgatcgaaaattttag

SEQ ID NO: 378 - protein, 414 aa, Unknown
  Obtained from environmental sample
  DOMAIN (4)...(395): FAD dependent oxidoreductase
  SITE (319)...(322): N-glycosylation site. Prosite id = PS00001
MSKKVVVIGSGIVGASCAYYLHKAGHEVVLLEKEQQGSGASYVNAGYITPSHIIPLAAPGMVQMGMKYLFDSSGPFYMKPRFDLDFIKWAWAFQKSCTKSNVQKAIPLIKALNIHSRELYEELLSCGDLGEFHWEDKGLLMVYKTQKAADSEGLVAEEARSLGLEVDQLDTNRLRELEPGFGEEVLGAWHYHCDRHSTPTDVLPRLLKYLRQHISFQKSKGVDHIKSTSLGVSLKCGQESLTADRVVIAAGVWSSQLAKQLGQRLHLEAGKGYRIDVENELNIGMPAISLEHKIAVTPMKGFTRFAGTMEFSGINTTVRPERVAAIAKAAQSLYANLDFSEQDLASAATGMRPVSPDGLPYIGPMADHPNIYLATGHAMMGWSLGPVTGHMIADMISERTPVLDSPHLRVDRKF

SEQ ID NO: 379 - DNA, 1257 bp, Unknown
  Obtained from environmental sample
gtgcgcgttctcatcattggcggtggactgatcgggctctgcagtgcgtacgagctgcgtaagctcggacacgaagtcacgatcatcgaacgtcgcgagggccccgccctcgaaaccagtttcgcaaacggcggattgctcacgccgagcatgtccgatccgtggaacgcgccggggagttggcgcgtgctgctcgcgtccctcgggcgttcggattcgccattgcagctgcggctgaaggccgtacccggcctcgcgcactggggcatcgacttcctgcgcaactcgagctccgcgcgattcgcacgcaataccctcaacaatgttcgcctggcgcagtattcgctgagtgcgctccgggagctgcgacggaccgagcgactcgaatacggacaaggcacggctggcacgatgcggctgtttcgcgaccgggacaaattcgccgcagcccagaaggcctccgcagcactcaccactgaaggcatttcgtcgcgcagcctggctcctgcggaggcgaccgtactcgaacccgcactgacagccatcgagcgccaactcgtcggcgcgatccactattccggcgatgaatccggcgatgcgtacgtcttctgccggcttctcgctgatcgagcgcaaaacctcggcgtcgaaattcgcttcaaccaggacgtgaaagcgctcgaggtccgcaacggcgccgtcgtgtccgctcgctgcggagcggacacattgcatgccgatcgcatcgtcgtcgccgcgggcagctacagtgcgccgttgttgcaacaggtgggggtcgacctgcccgtgcggccggggaaaggttactcggtcagtttcgatcgaccacgcgaacacagcctcagtatcgcgatgatcgatgatgacctgcacgccgcgctcactccgctagggaacacgctgcgcgccgcgggtaccgccgagttcgcgggattcgacctcacgctgcgacccgagcgcgtgcgcaacctgatgggcctggtcaatcggatcctgccgaagtcgaacatcgatctttccaaaggacggccgtggtgtggattccggcccatgtcatcagacggagtaccgatcatcggcagcaccccggttaccaacctgtgggtcagcagtggccacgggcctctcggctggaccatgtccgtgggctcaggtcgcttgctcgctcaactaatgagcgatctcaagcccgaaattgatcctacgccttacgcgctcgcacgctttgcatcctga

SEQ ID NO: 380 - protein, 418 aa, Unknown
  Obtained from environmental sample
  DOMAIN (2)...(398): FAD dependent oxidoreductase
  SITE (96)...(99): N-glycosylation site. Prosite id = PS00001
MRVLIIGGGLIGLCSAYELRKLGHEVTIIERREGPALETSFANGGLLTPSMSDPWNAPGSWRVLLASLGRSDSPLQLRLKAVPGLAHWGIDFLRNSSSARFARNTLNNVRLAQYSLSALRELRRTERLEYGQGTAGTMRLFRDRDKFAAAQKASAALTTEGISSRSLAPAEATVLEPALTAIERQLVGAIHYSGDESGDAYVFCRLLADRAQNLGVEIRFNQDVKALEVRNGAVVSARCGADTLHADRIVVAAGSYSAPLLQQVGVDLPVRPGKGYSVSFDRPREHSLSIAMIDDDLHAALTPLGNTLRAAGTAEFAGFDLTLRPERVRNLMGLVNRILPKSNIDLSKGRPWCGFRPMSSDGVPIIGSTPVTNLWVSSGHGPLGWTMSVGSGRLLAQLMSDLKPEIDPTPYALARFAS

SEQ ID NO: 381 - DNA, 1251 bp, Rhodococcus ruber DSMZ 44319
atgacggttcgtcggacggtggtcgtcggtgcgggcatcgtgggtctgtccaccgcgtggttcctgcaggaacgcggtatcgaggtcacggtgctcgatcgggtcggcgtggcgggcgacgcgtcgtggggcaacgccggatggctcgcgccggctctgaccctgccgctgcccgagccgggggtgctgcgttacggcttgcgctcgatgttccggccgtcctcgccggtgtacgtgccgcccacgacggatctgcggttgctgcgcttcctcgccgacttcgcgcggcactgcacgagacggaaatggacgtcgtcgatggaggtcttcgcgcgcgccaaccgcgtcgccctcgacgcctacgacgatctcgcccgcgggtcgggcgacacgatcgtcaccgagccgacgcgggtcgccgatccgttcctcgcggcgttcacctcggacgacgatcgacggctgctggtcgaggagttcgagcacgcacgtgccgcaggcagcgagatcgatttcgacctgctcgacaccgacacgctgcattcgctcgaaccgctgctcggggacccggtgcgggtcgggctccggatccgggggcagcggttcatcgatccgccgcggttcgtcgcctctctggcgcacgcggtccgcgcccggggcgcggagatcgtcaccgatgtcgacgtccaggaggtgcgcgacaccggtcgcggggtggacgtcgtcgtggccggtggcgactcccgttcggcggatgcggtggtgctcgcgaacggagcgtggcttgggcctctcgcccggccgttcggtgtgcgcacgcaggttcaggccggtcgcggctacagcttcagcgtgcggccgccgagcctgccgaagaacccggtctacttccccgcccagcgggtggcgtgcacacccctccaggaccgcttccgggtcgccggcatgatggagttccgcagccccgacgccccgctcgacccgcggcgcatcgaggcgatcgtcgacgcgacccgaccgctgctgcgcgatgtcgactgggacgggcgcagcgaggagtgggtgggctcgcgtccgtgcacggcggacgggctcccgctgatcggccgcacgcgttcggagcgggtgtacgtcgccggcgggcacgggatgtggggtgtggcgctcggtcccctcaccggacggctgctcgccgggtcgatgaccggcgagccggatccgttgctcaggtcgttcgatccgctgcgctga

SEQ ID NO: 382 - protein, 416 aa, Rhodococcus ruber DSMZ 44319
  DOMAIN (5)...(400): FAD dependent oxidoreductase
MTVRRTVVVGAGIVGLSTAWFLQERGIEVTVLDRVGVAGDASWGNAGWLAPALTLPLPEPGVLRYGLRSMFRPSSPVYVPPTTDLRLLRFLADFARHCTRRKWTSSMEVFARANRVALDAYDDLARGSGDTIVTEPTRVADPFLAAFTSDDDRRLLVEEFEHARAAGSEIDFDLLDTDTLHSLEPLLGDPVRVGLRIRGQRFIDPPRFVASLAHAVRARGAEIVTDVDVQEVRDTGRGVDVVVAGGDSRSADAVVLANGAWLGPLARPFGVRTQVQAGRGYSFSVRPPSLPKNPVYFPAQRVACTPLQDRFRVAGMMEFRSPDAPLDPRRIEAIVDATRPLLRDVDWDGRSEEWVGSRPCTADGLPLIGRTRSERVYVAGGHGMWGVALGPLTGRLLAGSMTGEPDPLLRSFDPLR

SEQ ID NO: 383 - DNA, 1260 bp, Unknown
  Obtained from environmental sample
atgatgaagatcatggtgctgggcggtggcgtcatcggtgtgaccaccgcctattatcttgccgaagccggccacgaggtgacggtgatcgagcgccagcaaggcccggcgctggaaaccagcttcgccaatgccggcgagatttcgcccggctatgcctcgccctgggccgggcccggcgttccgctgaaggctatcaaatggctgctgatgaagcatggtccgctggtggtgcggccggccttcgacccgcatatgtggggctggctggtgaaaatgctgcgcaactgcaccactgagcgctacgcgatcaacaagtcgcgcatggtgccgctggccgaatacagccgcgacacgctgaaggcgctgcgcgaagcgaccggcatcacgtatgacgaacggagccagggcacgctgcagctgtttcgcacgcaaaagcagctcgacggaacatcaggcgatgtcgaggtcctgaagaaatatggcgtgccctacgagatcctcgagcgggacggctgcatcggtgcggaaccggggctggccggcgtgcgcgagaaattcgtcggcggcctcaggctgccgcatgacgagaccggcgactgcaagatgttcaccgacaaactggctgagctttgcgtggcacgcggcgtcaaattcgaatacggcgtgacgatattgcgggccaatcgcaacagcaacagcatcgccaatctcagcaccgacaagggtgtgagaacggccgaagcctatgtgatggcgctgggcagctactcggcaggtttcatgcgtgggataaagcggccgatcccggtctacccagtcaagggctattcaatcacggtgccgatcaaggatgccgccgccgctcccgtatcgacggtcatggacgagacctacaaggtggccatcacccggctcggcgatcgcatccgcgtcggcggcaccgccgagatttcggggttcgatctcagactgcacgaatcgcggcgccgcacgctggaacactcggtcggcgatctttttccgggcgccggcgctctgcgggacgcgaccttctggtgcgggctgcggccgatgacgccagacggaccaccgctgatcgggcgcaccgagttttccaacctttatctcaacaccggtcacggaacgctcggctggaccatggcctgcggctcggccagggtgctggccgacatcatatcgagccgggcgcccgatatagacgtccgcgctctggcgcaggagcgctatctagaatag

SEQ ID NO: 384 - protein, 419 aa, Unknown
  Obtained from environmental sample
  SIGNAL (1)...(21)
  DOMAIN (3)...(399): FAD dependent oxidoreductase
  SITE (97)...(100): N-glycosylation site. Prosite id = PS00001
  SITE (106)...(109): N-glycosylation site. Prosite id = PS00001
  SITE (240)...(243): N-glycosylation site. Prosite id = PS00001
MMKIMVLGGGVIGVTTAYYLAEAGHEVTVIERQQGPALETSFANAGEISPGYASPWAGPGVPLKAIKWLLMKHGPLVVRPAFDPHMWGWLVKMLRNCTTERYAINKSRMVPLAEYSRDTLKALREATGITYDERSQGTLQLFRTQKQLDGTSGDVEVLKKYGVPYEILERDGCIGAEPGLAGVREKFVGGLRLPHDETGDCKMFTDKLAELCVARGVKFEYGVTILRANRNSNSIANLSTDKGVRTAEAYVMALGSYSAGFMRGIKRPIPVYPVKGYSITVPIKDAAAAPVSTVMDETYKVAITRLGDRIRVGGTAEISGFDLRLHESRRRTLEHSVGDLFPGAGALRDATFWCGLRPMTPDGPPLIGRTEFSNLYLNTGHGTLGWTMACGSARVLADIISSRAPDIDVRALAQERYLE

SEQ ID NO: 385 - DNA, 1245 bp, Unknown
  Obtained from environmental sample
atgaacgtaacaattattggtgggggcgtgatcgggttgaactgcgcttattttttgcaaaaggaaggacacaaggtgacagttattgatcgtggagatattaccgatggatgttcctttggtaatatgggttatgtttcgccatcgcattttattccattggcaacgcccgggattgtatcaaaagggttgaagtggatgatgagctcttcatcaccattttatataaaaccacgattgaatctcgatcttattcgctggggaatgacattctggaagagtgcgactgcaaaaaaaattgaagagaatgcaccgcacatgaataatctgctgcaattgacccggcatttgatgaatgatgttaaaaatgaattgcctgaatcctttgacatgacagaaaaaggatgttggatgctttggaaaagcgaaaagacaggtgatcatgaaaagcatttggctgagcaggcagatcgttacgggctgaaaacaattttttgtacaccacaacaagtgcaggagcacgagacccaggtagagacaagcgttgcaggtggtgtattgtatcttgacgactgtcatgtaaatcctggcaagtttatgcattcgatgtattcctacttaaaaagtaaaggcgtacaattttggttgaatacgaatgttacaagttttgaaacatccaatggtaagattaccgccattataaccgataaatcaaaacttgattgcgatgagttggtattagcaaacggctcctggctacagaaaatttctaaattgctaaatatttatactccactacaacccggtaagggttatagtatggtgtatgaggggctgcaaaagaatttgcagtatcccgctatactggttgatgaccgaactgcaacaacaccgatcaatggctggctgagaattggtggtacaatggagttgagtggtcatagtgataatattttaccgaaaagagtaatggcgatttataatgcttttaaaaaatattatccaacaatgaatttgccacagcctaatatcaataaagcctggtttggttatcgtcctgtgagtccggatggcatgccatatattggaaggcataaaaaatattccaatcttagttatgctggcgggcatgcaatgttgggggttactgcggcggctggaacaggaagacttattgaagagattatttcagggaaaaaatcctcgtttgcattggaagcttttgagccatcccggttcgaatga

SEQ ID NO: 386 - protein, 414 aa, Unknown
  Obtained from environmental sample
  DOMAIN (2)...(395): FAD dependent oxidoreductase
  SITE (2)...(5): N-glycosylation site. Prosite id = PS00001
  SITE (222)...(225): N-glycosylation site. Prosite id = PS00001
  SITE (252)...(255): N-glycosylation site. Prosite id = PS00001
  SITE (375)...(378): N-glycosylation site. Prosite id = PS00001
MNVTIIGGGVIGLNCAYFLQKEGHKVTVIDRGDITDGCSFGNMGYVSPSHFIPLATPGIVSKGLKWMMSSSSPFYIKPRLNLDLIRWGMTFWKSATAKKIEENAPHMNNLLQLTRHLMNDVKNELPESFDMTEKGCWMLWKSEKTGDHEKHLAEQADRYGLKTIFCTPQQVQEHETQVETSVAGGVLYLDDCHVNPGKFMHSMYSYLKSKGVQFWLNTNVTSFETSNGKITAIITDKSKLDCDELVLANGSWLQKISKLLNIYTPLQPGKGYSMVYEGLQKNLQYPAILVDDRTATTPINGWLRIGGTMELSGHSDNILPKRVMAIYNAFKKYYPTMNLPQPNINKAWFGYRPVSPDGMPYIGRHKKYSNLSYAGGHAMLGVTAAAGTGRLIEEIISGKKSSFALEAFEPSRFE

SEQ ID NO: 387 - DNA, 1251 bp, Unknown
  Obtained from environmental sample
gtgaggatcgtcgtcctcggcgccggcgtcgtcggcacgacggcggcctattgcctggctcgggacggtcacgaggtggtcgtcgtcgagcggcacgcggccgtcgcgcacggcaccagctattccaacgccgggctggtttcgccaggcgacgctacagcgtgggcgtcgcctgccgcgctcagaaccttcttgcagtcgctctataggcccgatctcggcatcaaggtcaggttgcggttcgatccctacttcattttgtggagtctgcgctttctggcccagtgcacgactgcgcgctgccgtgcgaacacagaggtcaagctcaggctggcgctctattcccgcacctgcatcaacgagatcgcagccgaggccggtatcgactacgaccagcgggcaagaggtatcctctacttcttccggtccgagcagagcctggccgccggcaccggcaacctcaaatatctcgccgagcacgggcttcggatcgaaatcgtcgaccgcaaccggctgctcgagctcgagcccggtctcgccggcgccagggacacgatcgcaggcggcgtctattcgccgatggaccagaccggcgattcacgactgttcgtcgagaggctcgcggcacatgcggccgaacggctcgcggtggagttccggttcggcacgacggtccagggattggacgtcggccgggaccgtgtccgcgccgtgaagacgtcccacgggccgattgcggccgatgcggttgttgttgcgatgggtcccgaaagcgggctgctcggacgcaaatatggcatcgacctgccggtctatccggtgaagggctacaccgtgacggtgccgctcaggaaccccggcaagggaccgaccatgggcggcgtcgacgaggatcgactgatcgcctattcgcgcctcggcgatcgactgcggctcgccgcgaccgccgagttcgccggcttcgaccgcagccacaagccgagcgatttcgcggcgctgttccgtacggctcacgagctcttcccggatgcgttcgacgaaagcgaggcggagcggtgggcgggacttcggccgatgatgcccaactccgtcccggtcatcggccgcgcgaggtacagcaacctgttcctcgacaccggccacggccatgtcggctggacgatggcggcgggatcggcacgcctgcttgccgatctggtcgcggggcgcaagcctgccatcgatccgacgggactgctctacaagtcgtag

SEQ ID NO: 388 - protein, 416 aa, Unknown
  Obtained from environmental sample
  SIGNAL (1)...(20)
  DOMAIN (2)...(399): FAD dependent oxidoreductase
  SITE (290)...(299): Aminoacyl-transfer RNA synthetases class-I signature. Prosite id = PS00178
MRIVVLGAGVVGTTAAYCLARDGHEVVVVERHAAVAHGTSYSNAGLVSPGDATAWASPAALRTFLQSLYRPDLGIKVRLRFDPYFILWSLRFLAQCTTARCRANTEVKLRLALYSRTCINEIAAEAGIDYDQRARGILYFFRSEQSLAAGTGNLKYLAEHGLRIEIVDRNRLLELEPGLAGARDTIAGGVYSPMDQTGDSRLFVERLAAHAAERLAVEFRFGTTVQGLDVGRDRVRAVKTSHGPIAADAVVVAMGPESGLLGRKYGIDLPVYPVKGYTVTVPLRNPGKGPTMGGVDEDRLIAYSRLGDRLRLAATAEFAGFDRSHKPSDFAALFRTAHELFPDAFDESEAERWAGLRPMMPNSVPVIGRARYSNLFLDTGHGHVGWTMAAGSARLLADLVAGRKPAIDPTGLLYKS

SEQ ID NO: 389 - DNA, 1317 bp, Unknown
  Obtained from environmental sample
atgaaagtcatcgttttgggttcgggcatcatcggcactgcttcagcgtggttcttgaacaaggccggacatgatgtgacagtcatcgaacgccagcccggcgctgctcaggaaaccagtttcgccaacggctgccagatttcggtatcgcacgcggaaccctgggccaatccttccgccccgaagaaaatcttcaaatggctgggtcaggaagacgcgcccctgctttaccgcttccgtcccgaatggctgcaatggaaatggggaatgcacttcctgcgtgaatgcactcccgcgcgcacggcctataacatccgccagatcgtggccatcgcggaatacagccggcagacgctgcaggcggtgcgcgccgaaaccgggatcgaatatgatcacctgactcggggcattctgcatttttataccgacgaaaaggagttcgaagagtcgttgccggccgccaagctcatgcgtgatctcggttgcccgcgcgagtcgatcggcgcggatgaagtcgtgaagatcgagccggcgctcatgggaatccgcgacaggatcgtcggcggcgactttacacagacggacgaatcgggcgatgtgttcaaattcacgaccggcctggccgccagggcagcgcaggccggcgtcgaattccgcttcaacaccaccgtcacgcgcctgctgaacgaagggtcgggtgcgtcggccaaggtcactggcgtggaaatcatcgatccgcaaggccgtcatcaggtgctgcgcgccgatgcgttcgtgctggccatgggcagcttctcggtgccgctggtcaagccgctggggatcgacctgctgatctatccgggcaagggatattccgccacctatgcggtcaaggacgccgctgccgcaccaaccgtgtcgctgaccgacgatggatacaaactggtgatctcgcgcctcggcgatcgcctgcgcgtggccggcacttgcgaactcaacggttatacccgggaactcaacagtacccgctgcgaggccatcacgcgccgcacccgggagctgtttccggacgcctgcgactacgataatccggttttctggaccgggctgcgtccgctcacgccgtcgaatgtgccgtacatcggcaagacgaagatcggcaacctgtatctcaacaccggccacggcacgctgggctggaccatgggttgcggttccggtcgcgcgatcgcggaaatcgtttccggccgtgttcccgaaatcgactttgccttcaccggcgtcgatcgtgatccggccaagggggggatcatgtcacatcccgcgcgcgcctga

SEQ ID NO: 390 - protein, 438 aa, Unknown
  Obtained from environmental sample
  DOMAIN (2)...(407): FAD dependent oxidoreductase
  SITE (224)...(227): N-glycosylation site. Prosite id = PS00001
  SITE (339)...(342): N-glycosylation site. Prosite id = PS00001
MKVIVLGSGIIGTASAWFLNKAGHDVTVIERQPGAAQETSFANGCQISVSHAEPWANPSAPKKIFKWLGQEDAPLLYRFRPEWLQWKWGMHFLRECTPARTAYNIRQIVAIAEYSRQTLQAVRAETGIEYDHLTRGILHFYTDEKEFEESLPAAKLMRDLGCPRESIGADEVVKIEPALMGIRDRIVGGDFTQTDESGDVFKFTTGLAARAAQAGVEFRFNTTVTRLLNEGSGASAKVTGVEIIDPQGRHQVLRADAFVLAMGSFSVPLVKPLGIDLLIYPGKGYSATYAVKDAAAAPTVSLTDDGYKLVISRLGDRLRVAGTCELNGYTRELNSTRCEAITRRTRELFPDACDYDNPVFWTGLRPLTPSNVPYIGKTKIGNLYLNTGHGTLGWTMGCGSGRAIAEIVSGRVPEIDFAFTGVDRDPAKGGIMSHPARA

SEQ ID NO: 391 - DNA, 1257 bp, Unknown
  Obtained from environmental sample
gtgagttcgacacgcagagtcatcgtcatcggcggcggagtcatcggcgcggccagcgcgtactttctgaatcgcgccggctggcaggtcacgatcatcgaaaaaaacgaatacggccgcggctgctcgcacgcgaactgcggattcgtcagccccagccacattttgccgctcgctgaacccggcgtgctgatgaaaacggcgcgtacgatgttcaagaaggactcgcccttttacatcaagccgcgctacgatccggtgctctggaaatggctgtacaatttcgccggccgctgcaacgtgaaagacatgctgcaatccgcgcaggccattcatgcgctgctgcaatcatctcgcacgctctaccgcgaggtcatcacagaagaaaagttggactgcgaattcgaagaacgcggcctgctgatggtttttcgcacgcaggctaagatgaatgtcttcgcggagaccgatgcgctgctgcacgagaaattcaacgcgcccgcgcggcgctttgacggcgacgcgctgaacgattttgagccggcgctgaaacgcgggcttgcgggcggctggctctacgaaatggatgcgcacttgcgaccagacaagttgatgcgcgaatggcggcgcgtgctaacttcacgcggcgtaaaaattctggaacgctgcgaagtgcacggtttcgagccgcagagcggcagtgccggcgcactgaaaaccgcgctcggcaccttccatgcggacgagtatgtgctcgccgccggcgccctgacgccgcgtatgaatgacgccctgggcgtgcggattcccattcagcccggcaaaggttattccatgaccatgccgcgcacaaaacagtgccccaagtatcccctcatttttccggagcataaggtcgcggtcacgccgatgcagtccggctacaggctgggctcgatgatggaattctgcggctacgattctcgcgtcgacccgcagcgtttgcagattttgcgccgcggagccgagcattatttgcaggaaccgtattgcgagccagtcgtcgagaaatggtgcggctggcgcccgatgacatacgacagcgtgccgatcatcgaccgcagcccggcgctgcgaaatgtgctgatcgccgccggccacaatatgcttggactttcgatgagcaccgggactggcaagctggtgagcgagattctttcgggcgcggagccgcacgttaataaagatttgtattcgctggcgcgtttcaaatcctga

SEQ ID NO: 392 - protein, 418 aa, Unknown
  Obtained from environmental sample
  SIGNAL (1)...(20)
  DOMAIN (6)...(398): FAD dependent oxidoreductase
MSSTRRVIVIGGGVIGAASAYFLNRAGWQVTIIEKNEYGRGCSHANCGFVSPSHILPLAEPGVLMKTARTMFKKDSPFYIKPRYDPVLWKWLYNFAGRCNVKDMLQSAQAIHALLQSSRTLYREVITEEKLDCEFEERGLLMVFRTQAKMNVFAETDALLHEKFNAPARRFDGDALNDFEPALKRGLAGGWLYEMDAHLRPDKLMREWRRVLTSRGVKILERCEVHGFEPQSGSAGALKTALGTFHADEYVLAAGALTPRMNDALGVRIPIQPGKGYSMTMPRTKQCPKYPLIFPEHKVAVTPMQSGYRLGSMMEFCGYDSRVDPQRLQILRRGAEHYLQEPYCEPVVEKWCGWRPMTYDSVPIIDRSPALRNVLIAAGHNMLGLSMSTGTGKLVSEILSGAEPHVNKDLYSLARFKS

SEQ ID NO: 393 - DNA, 1257 bp, Unknown
  Obtained from environmental sample
atgaaaatcctcgtgatcggtgccggcgtgatcggcgtcgccaccgcctgggccttgcaggaagcggggcatacggtcaccttggtggatgcgcgcgaggcgccggggcgcggtgcttgttatgccaacggggcacagatctcggtgagccatccgcacccttggtccagccccagggcaccgttgatcgcgctggagtcgctcacacgcgaggacgggccattccgctggcgcccagcgctcgatacggcgcaatggtgctggctcacggcgtttctgcgcgaatgcctgccctcgcgccatgagcgcaacacgcgggcgattgcgctccttgcgcgccacagcctccaggtgctgcggcgctggcgcgaggcgctggggctcgagtacgacgtgcagacgcgcggcatcctgcaccttttcttcactccgcgcgactgggaaaccggccggcggcacgaggcggagctgcgtgagctgggcatcgccgcccgggcgatctcacccgcagaggcggcggaaatcgagccggcgctcgcgccggtggccgcgaagctctgcggcgccctgtacgcgccggaagacgaatcgggcgatgcgcgccgattctgcgaggagatggtggcgcggctgcgccaggccggggccgaggtgctcttcgagacgcgctggagcggctggcgtctgggcaaaggccgctgcgaagcggcacgcttcgaggggccggcgggggcgttcgagctcacggccgaagccatcgtcgtctgcgccggggtggacagcccgcgtctgctcgcacccctggggatggaggcgccgatctatcccgtcaagggctattcgctcacggcacccatcctcgcgccggagcgcgcgcccaccgcttcgctcaccgacgaatcgaagcgcatcgtgtgctcgcggcttggcaaccgtttgcgctttgccggtacggccgagatcgccggctacgacgactcggtgcgccccgagcgcatcgcgcccttgaagcgctgggccgaggtgatgctgcccggcgtggcggatctggaagcggccgaagcctgggcggggctgcggcccatgacgccgagcggcgtgccgctcatcgggcgcagtcccatggcaaacgtgtgggtgaacaccggccacggttcgctgggctggacgctcgcctgcggttcggcgcaggcgctgctcgcccggctggagggaaagacgccgcccgggctggaagcctttcccttcgtcggttga

SEQ ID NO: 394 - protein, 418 aa, Unknown
  Obtained from environmental sample
  SIGNAL (1)...(18)
  DOMAIN (2)...(402): FAD dependent oxidoreductase
MKILVIGAGVIGVATAWALQEAGHTVTLVDAREAPGRGACYANGAQISVSHPHPWSSPRAPLIALESLTREDGPFRWRPALDTAQWCWLTAFLRECLPSRHERNTRAIALLARHSLQVLRRWREALGLEYDVQTRGILHLFFTPRDWETGRRHEAELRELGIAARAISPAEAAEIEPALAPVAAKLCGALYAPEDESGDARRFCEEMVARLRQAGAEVLFETRWSGWRLGKGRCEAARFEGPAGAFELTAEAIVVCAGVDSPRLLAPLGMEAPIYPVKGYSLTAPILAPERAPTASLTDESKRIVCSRLGNRLRFAGTAEIAGYDDSVRPERIAPLKRWAEVMLPGVADLEAAEAWAGLRPMTPSGVPLIGRSPMANVWVNTGHGSLGWTLACGSAQALLARLEGKTPPGLEAFPFVG

SEQ ID NO: 395 - DNA, 1242 bp, Unknown
  Obtained from environmental sample
atgacaaaggacattgtggtactcggcgccggcgtggtgggcgtatgcacggcgctggcgctgcgccagcgcggccacgcggtggtgctggtcgatcgccaggcaccggggagagagacctcttacggcaatgccggcatcattcagcgagaggccgtgcaaccctatgcctttccacgggaatggcaggccatcctgcgggttgccctgcgccagggcaacgatgtgcactaccatcctggggcgctggcacacctggcaccggcgctggtgcgttactggcgcgagtcggcgcccgatcgctatgcctcggtcgtaaccgcctacagtgcgctgatccgccactgcctgagcgagcacgagcgactgatcaccctcgccggcgcacaagacctggtgcgcaagtcggggtggctacaggcctaccgcacggcgcgagcgttcgaccgggccgcgcgcgaggccagcacagtcgcgcgcgtgcacggcctggattgtcaggcgctcgaccaggctggcgtgacggccacggagccggccctttatgggcggctcgccggcgcgatccactggcgcgatccctggacggttgccgatcccggagagcttgtcacacgttatgccgcgctcttcgagcgcgagggtggcaacttccgccgcggcgatgccacgacgctgaagcctgccggcgccggctggaccgtgaccaccgaagaaggcccgctgagcgcggcacacgtggtgatcgcactcggtccatgggccgcggccctgatcgagaggctcggttatcgctttccgctattcgtcaagcgtggctatcaccgccactatgcggccgagccgatgccccggctgccggtgctcgacgtcgagaacggcgtcatgctggcgccgatgcagcggggcctgcgcctgaccacgggcgcggagtttgccctgcgcgatgcgccgccgacgcctgtccaattggagcgtgcagaaggctacgcgcgcgaactggtgcggctggggcagccagccgaagcgcagccgtggctcggcgcacgcccctgcgtggccgacatgaagcccatcgtgggcagggccccgggccatcacggtctctggttccactttgggcatggccatcagggcttcacgctcgggccagtcacggcacgtctgctcggcgagctgatcgacggcgagcaaccctacgtcgaccccttgccctacgatccaatgcggtttgccgtttga

SEQ ID NO: 396 - protein, 413 aa, Unknown
  Obtained from environmental sample
  DOMAIN (4)...(393): FAD dependent oxidoreductase
MTKDIVVLGAGVVGVCTALALRQRGHAVVLVDRQAPGRETSYGNAGIIQREAVQPYAFPREWQAILRVALRQGNDVHYHPGALAHLAPALVRYWRESAPDRYASVVTAYSALIRHCLSEHERLITLAGAQDLVRKSGWLQAYRTARAFDRAAREASTVARVHGLDCQALDQAGVTATEPALYGRLAGAIHWRDPWTVADPGELVTRYAALFEREGGNFRRGDATTLKPAGAGWTVTTEEGPLSAAHVVIALGPWAAALIERLGYRFPLFVKRGYHRHYAAEPMPRLPVLDVENGVMLAPMQRGLRLTTGAEFALRDAPPTPVQLERAEGYARELVRLGQPAEAQPWLGARPCVADMKPIVGRAPGHHGLWFHFGHGHQGFTLGPVTARLLGELIDGEQPYVDPLPYDPMRFAV

SEQ ID NO: 397 - DNA, 1245 bp, Unknown
  Obtained from environmental sample
atggcacgtactgatgtaatggtccttggtgccggtatcgtcggcacttcaatagcgcttcatcttgcaaggcgtgggctcagcgtcgcgctggtcgaccgcgccggcatcggcgaacagacgtcctatgggaatgccgggatcattgagggcaacacgattttcccgccggcttttccatccggttttagcgcgctgttgcgcatcgcattcaaacgcgcaagcgaagccaattatcacgtttcttttctgccgagcgttgctccctggctgctggcgttccgcgcggcctcccggccggaaaacctggctgaaaccgctcagctgatccggccgctgttttccagcgcggtcgccgagcacgagacgctgctggccgaggcaggcgcaaccaaatatctgcgcaaaaccgggtggctcaaagtttaccgcactgaaaagcgtttcaaatccctggcgcccgagttcgacttggccgcgaagttcggactgccgctgcggtcacttgatactgccggggcacaggcgctcgagccatctctcaatccggtcttcgcgcatggtgtgttctggccggaagccgcaagtatcagtaacccgctcggtgtgacgcgggcttatgcggcgcgttttgccgggctcggcggcgtctttctgaccggcgatgcgcggacgctgcaccgatccggcagcaattggcgggtagagacggagcagggagcgctcgacgcaagccagtgcgtgattgcgctcggtccctgggctcccgatctgttgaggcaactgggcatcaagctgccgctcgcggtaaagcgcggctatcaccggcacttcaacgcgcagggcaacgccgggcttgcgcgtcccgtgctcgacgcagacgtcggttacctgatcacgcctatggagcagggtatccgcatgacgaccggtgtggaattcgctgcacgcgatgcccagccttcgcccgtgcaatttgaccgcatcatgccccgggcccgtgagttatttccgctcggcgagcgggccgacgacagaacctggatgggtagccggccgtgcttgccggactcccggccggtgatcggccgcgcgccgagattgtccggactttggctggcggttggacatgcccactggggcttaacgcttggcccggcaaccggccgactcattgcggaaatgatggccggcgaaacaccgttttgcgatccggcgccgtacagttccgaacggtttagctag

SEQ ID NO: 398 - protein, 414 aa, Unknown
  Obtained from environmental sample
  DOMAIN (5)...(395): FAD dependent oxidoreductase
  SITE (368)...(380): Lipocalin signature. Prosite id = PS00213
MARTDVMVLGAGIVGTSIALHLARRGLSVALVDRAGIGEQTSYGNAGIIEGNTIFPPAFPSGFSALLRIAFKRASEANYHVSFLPSVAPWLLAFRAASRPENLAETAQLIRPLFSSAVAEHETLLAEAGATKYLRKTGWLKVYRTEKRFKSLAPEFDLAAKFGLPLRSLDTAGAQALEPSLNPVFAHGVFWPEAASISNPLGVTRAYAARFAGLGGVFLTGDARTLHRSGSNWRVETEQGALDASQCVIALGPWAPDLLRQLGIKLPLAVKRGYHRHFNAQGNAGLARPVLDADVGYLITPMEQGIRMTTGVEFAARDAQPSPVQFDRIMPRARELFPLGERADDRTWMGSRPCLPDSRPVIGRAPRLSGLWLAVGHAHWGLTLGPATGRLIAEMMAGETPFCDPAPYSSERFS

SEQ ID NO: 399 - DNA, 1242 bp, Unknown
  Obtained from environmental sample
atgaaagttacaattatcggtggcggagtcattggattgtgcagtgcttattacctgcaaaaaaacggctaccgggttactgttattgatcggcaggatatcacggaaggttgttcctttggtaatatgggttacatttccccgagtcattttattccattggctactcccggcattatatcccaggggttgaaatggatgatgagctcgtcaagccctttttatatcaagccaagactgaacctggatttgattaaatggggacttgcatttcgcaaaagcgcgaatgcaggaacagtagaactgaatgctcctcacctgaacaacctgcttcaattgagccgggaactgatgactgatttgaaaaaagatcttccgccttttgaaatgattgaaaggggttgctggatgttgtacaaatccgcaaaaacaggagaacacgaaaaacatattgctgaccaggcaaatcaattcggattaaaaaccattcaatgtgatgcggcgcaggtgcaggcttcggaaccggatgtggaagtaaatgttgccggaggtgttttgtatcaggatgactgccatgtaaggcccgaatcttttatgcaggctttatatgattatctgaaaaaggaaaaagtagaattctggctgaatacggaagtcacggggtttgaaaaggacaatggcaggataactgcgatacttacatcaaatggaaaatttgcggcggatgaaattatcatcgcgaatggctcctgggtgcccgaggtgtcaaaactgcttggcatatccatgctgatgcaaccgggaaaaggctacagtgtcgaatataatggactggaaaaaaacctgcggcacccgtcaatacttgtagatgatcgtactgctacatcgcctgttggcaaatggttacgtatcggcggaaccatggaactcagcggccatagcgataacattctgccaaaaagagtgatggccgtttacaatgcatttaaaaaatattatccttcaataaatatccctgcgcccaatgctcctgctgcatggtatggttacaggcccgtcactcctgatggcatgccgtacataggcaggcataataaattcagcaaccttatgtatgccggcgggcatgccatgctcggggtttctgcagctgccggtaccggcaaattaatggaagaaataaccggtaataaaaaaacaacgatcagtatagcagctttcgatccggaacgtttttcatag

SEQ ID NO: 400 - protein, 413 aa, Unknown
  Obtained from environmental sample
  DOMAIN (2)...(394): FAD dependent oxidoreductase
  SITE (251)...(254): N-glycosylation site. Prosite id = PS00001
MKVTIIGGGVIGLCSAYYLQKNGYRVTVIDRQDITEGCSFGNMGYISPSHFIPLATPGIISQGLKWMMSSSSPFYIKPRLNLDLIKWGLAFRKSANAGTVELNAPHLNNLLQLSRELMTDLKKDLPPFEMIERGCWMLYKSAKTGEHEKHIADQANQFGLKTIQCDAAQVQASEPDVEVNVAGGVLYQDDCHVRPESFMQALYDYLKKEKVEFWLNTEVTGFEKDNGRITAILTSNGKFAADEIIIANGSWVPEVSKLLGISMLMQPGKGYSVEYNGLEKNLRHPSILVDDRTATSPVGKWLRIGGTMELSGHSDNILPKRVMAVYNAFKKYYPSINIPAPNAPAAWYGYRPVTPDGMPYIGRHNKFSNLMYAGGHAMLGVSAAAGTGKLMEEITGNKKTTISIAAFDPERFS

SEQ ID NO: 401 - DNA, 1260 bp, Unknown
  Obtained from environmental sample
atgaaaacgcttgtactgggcggcggcattgcagggctctcgagcgcatttgcccaacaggagcgtggcgacgaagttgaagtcctcgaggcaagggaagctgttggcctggagaccagttttggaaacggcgggctgatgactgcctcgctctgtgagccctggaaccagccggggatatcccgcctgatgatcccagcgctttttggcggcaaaaactccatgctgcggattcatccccgggcattgccctcgctggcggtctgggggctcaagtttctcgccagctctggccaggcgcagttcctggagtcctcggcggcgcagtaccgactgtcgacctactcccaggaaaagacacgcgccctgatccaggagcagggcttcgatatcaagttccagaacaacggcatcctgcaggtgttcagggaccgggaagccctcgatcacgcgatagcaatccaccgccagtacgattcatttggcctgtcctacgaggtgctggataagccggctgcattgcagagtgagcctcacctcgaacacagcgccgatgacctggttggcgcaatctattacgaggacggcagtcgcggcgagtgtcccatgttctgtgaacaactggccgggttgctggagtcacgcggcgcggttattcgcaccggcgcacaggttcagaaaatcctggtggagcggggccgcgcggtaggcgtaatgacaagcgatggcgaagtacgcgcggacagggtaatcgtcgcactgggtaatgccgcgcccgccgtgttgcgaacggctggcgtgggactgccgatacggcccgccaagggctacaccatcacggtgccagtcgaggcagagctgccaaaatcaatcatgctggatgtcgggttgcacatcggtattatcccgatccacgccgacaacaccttgcgtattgggggtggcgcggagttcgccctcaacgacaagaccttctacgagcgctatgccgagagttcctacggcaatgtcgagaagaccctcccgcacctggttcctcacctgaggcgcgaccaggcagaaacctgggccggtttccggccagtgtcctatgacggaaagccctttataggcgggtgcaagattgaaaacctatacatcaatgggggactggggcacatgggttggacccagggcatgggtgccggtgcactattggcggacgtgatagcgggtacccggccagagattgaccccgacccctacaggttgcagcggtag

SEQ ID NO: 402 - protein, 419 aa, Unknown
  Obtained from environmental sample
  SIGNAL (1)...(18)
  DOMAIN (2)...(402): FAD dependent oxidoreductase
MKTLVLGGGIAGLSSAFAQQERGDEVEVLEAREAVGLETSFGNGGLMTASLCEPWNQPGISRLMIPALFGGKNSMLRIHPRALPSLAVWGLKFLASSGQAQFLESSAAQYRLSTYSQEKTRALIQEQGFDIKFQNNGILQVFRDREALDHAIAIHRQYDSFGLSYEVLDKPAALQSEPHLEHSADDLVGAIYYEDGSRGECPMFCEQLAGLLESRGAVIRTGAQVQKILVERGRAVGVMTSDGEVRADRVIVALGNAAPAVLRTAGVGLPIRPAKGYTITVPVEAELPKSIMLDVGLHIGIIPIHADNTLRIGGGAEFALNDKTFYERYAESSYGNVEKTLPHLVPHLRRDQAETWAGFRPVSYDGKPFIGGCKIENLYINGGLGHMGWTQGMGAGALLADVIAGTRPEIDPDPYRLQR

SEQ ID NO: 403 - DNA, 1257 bp, Unknown
  Obtained from environmental sample
atgtcaaaaaaaggcacctccgtcatcatcggtggcggaatttcgggtctggcttcggcctattatttgctcaaaagcggatggaaagtgacgttgctcgacaagggcgacttgttcgataactgctccatcggcaacgcgggcatgatcgtgccgagccattttatcccgctggctgctccgggcatggtttcgaagggtattaaatggatgttcaacagccgcagccctttttatgtaaaaccatccctcgatttctctctcatttcatggggtttgaaattcatgaaagcggccactgaggccaatgtagagcgcgcggcgccgcatttgcgggattatcatttattaagtaaaaagctttacgaagacctcgttcacgacgaaaacctggactttggcctggaagaaaagggtatattaatgctctacaaatccgataagaccggcgaagaggaaatccatgtagctaagcaaggccagcaactcggtctcgacatcgatatgctcaaccgcgagcaggtacaagcattggaaccgggcattaaactcgacgtagccggagctgtgcattaccgttgcgacgcgcatttgtacccgaccgctttggtgaatggcttgatcaaaagcattaccgcgctcggtgccgaaattgtcaaaaacacggaagtaacaggtttcgacattcaaaatggcgaaatcaaaagagtaaaaaccgctgccaaaacctacgaaggagatctggttgtcatgacgggaggctcctggctgccgcaactggccaaacacgccgggttatctattccggtaatgcctggtaaaggctactctttcatggagcccaactcccaacatcctattgtccaccctgcactactcctcgaagcccgcgtggccgttacgcctatgaacgggcaagtgcgcttcggcggtaccatggagcttgcgccgctcaacaatcagatcaatatgaacagggtggaggggatcgtcaattccatcccgcaatattatcctgaactcgatgtggccgttccgggaaaggaccgcatttggtacggtttccggccttgctcacccgatgggttgccctatctggggtattccagaaaattgagcaacctgatcgtcgccggtgggcacggtatgatgggtatcagcctcggacccggcaccgggaaaattgtggccgagctggcggagcgtgtgaagccttccgtagatgtagcgctctacgatccggaacgttatcaatag

SEQ ID NO: 404 - protein, 418 aa, Unknown
  Obtained from environmental sample
  SIGNAL (1)...(20)
  DOMAIN (6)...(399): FAD dependent oxidoreductase
  SITE (41)...(44): N-glycosylation site. Prosite id = PS00001
MSKKGTSVIIGGGISGLASAYYLLKSGWKVTLLDKGDLFDNCSIGNAGMIVPSHFIPLAAPGMVSKGIKWMFNSRSPFYVKPSLDFSLISWGLKFMKAATEANVERAAPHLRDYHLLSKKLYEDLVHDENLDFGLEEKGILMLYKSDKTGEEEIHVAKQGQQLGLDIDMLNREQVQALEPGIKLDVAGAVHYRCDAHLYPTALVNGLIKSITALGAEIVKNTEVTGFDIQNGEIKRVKTAAKTYEGDLVVMTGGSWLPQLAKHAGLSIPVMPGKGYSFMEPNSQHPIVHPALLLEARVAVTPMNGQVRFGGTMELAPLNNQINMNRVEGIVNSIPQYYPELDVAVPGKDRIWYGFRPCSPDGLPYLGYSRKLSNLIVAGGHGMMGISLGPGTGKIVAELAERVKPSVDVALYDPERYQ

SEQ ID NO: 405 - DNA, 1239 bp, Unknown
  Obtained from environmental sample
atggttcttggcgccggcgtggtggggctttgcaccgcccattatctccagcgccgtggttttcgcgtcaccgtggtcgatcgcgaaggtccaaaacgaagcagttgttcgtatggcaatgccgggctcatcgttcccagtcactttattccgcttgccgcgccgggtatggtcgccctgggcttgcgctgcatgtggaatcccgaatcgccattttatttgaagccgcggttctcggctcggttaatcaactggggctggaaattctggcgggcatcgacgcaaacgcgcgttgcccgggccgcgcctttgttgcgcgatttgaatttggccagccgagcggagtacgagcaattagtcggcgaactggatggcagcttcacgctggtgaaaaacggcgtcctgttgttgtgcaataccgagcacggtttgcacgaggaagcatgtgtggcggagcaaggaaaacaattgggattgcccgtggaagtgctcgacgccaggcaaacggcccagcaggatcccaacgtgaggatgaacgtcgtcggctcggtgatgtaccgctgcgattgccatctgacacccggccaggtcgtgcaatcgctgcaggcgagtctcgaatcgcgcggcattgcgtttcgatggaacacacacgttgatcaagtgcggcgcgaaggacgaaagatcgtcgccttctcggccgcgggtcaggaactcgaggccgatgagtatgtgatggcggccggcgtctggtccgacgacatgcttcggcaaatcggcgtgaacattcccatgcaggcgggcaagggttacagcctgacgctcaccaacccgccgcgcctgccacgaatgccttccattcttgtcgaaggccgtgtggcagtcacgccaatggggacttcgctgcgatttggcggcacgatggaactggccggcatcgaaacgaaaatcaaccctccgcgggtgcgcggcattgtcaagtcggcgctcgcctactttcccgatttcagcgaggccgactttgcagcggtcgaaccctggtgcggtctgcgtccctgcacgcccgacgggcttccctatttggggcgctcaacaaagttcgacaacctcaccattgccacgggccacgcgatgatgggcatgagtctggggccgatcaccggcaagatcgccgccgatttgattgcaggcgacagcccgccgttcgatttgcagttgttgtcgcccgagcgctacgactga

SEQ ID NO: 406 - protein, 412 aa, Unknown
  Obtained from environmental sample
  DOMAIN (2)...(393): FAD dependent oxidoreductase
  SITE (373)...(376): N-glycosylation site. Prosite id = PS00001
MVLGAGVVGLCTAHYLQRRGFRVTVVDREGPKRSSCSYGNAGLIVPSHFIPLAAPGMVALGLRCMWNPESPFYLKPRFSARLINWGWKFWRASTQTRVARAAPLLRDLNLASRAEYEQLVGELDGSFTLVKNGVLLLCNTEHGLHEEACVAEQGKQLGLPVEVLDARQTAQQDPNVRMNVVGSVMYRCDCHLTPGQVVQSLQASLESRGIAFRWNTHVDQVRREGRKIVAFSAAGQELEADEYVMAAGVWSDDMLRQIGVNIPMQAGKGYSLTLTNPPRLPRMPSILVEGRVAVTPMGTSLRFGGTMELAGIETKINPPRVRGIVKSALAYFPDFSEADFAAVEPWCGLRPCTPDGLPYLGRSTKFDNLTIATGHAMMGMSLGPITGKIAADLIAGDSPPFDLQLLSPERYD

SEQ ID NO: 407 - DNA, 1266 bp, Unknown
  Obtained from environmental sample
gtgaaagttctgatcctcggcagcggtgtcatcggcgtcacctccgcctactacctcgcccgtgccggccatgaggtgacggtcgtcgaccgtcagccggagccggcactggagacctctttcgccaatgccggcgaggtatcgcccggctattcctcgccatgggccggcccaggcgtgccggtgaaggcggtcaagtggctgttgatgaagcacggcccgctggtgatccggccgaagctcgatccggtgatgtgggtctggctgctgaagatgctgcgcaactgcaccagcgcgcgctacgcggtcaacaagagccggatgattccgattgcggaatacagccgcgatgccttgcgcgatctgcgccgccagatcggcatccaatatgacgagcgctcgcagggcaccctgcagctgtttcgctaccaggcccagctcgacggcaccgccgaagatatcgccgtgctgaagcaatacggcgttcccttcgaggtgctgagccgcgagggctgcatcgccgtcgagccggcgctgggcggcgtgaaggagaagttcgtcggcgggctccgcctgccgcaggacgagaccggcgattgccacatgttcacgcagtcgctggccaagcatgcccaggcgctcggcgtccgcttcatgttcaacacctcgatcgatcgcatcgtcaccgagggcgcgcgcgtcagcggcgtcgcgaccagcgccggcctgttgcaggcggacgcttacgtgctcgcgctcggcagctggtcgtcgcggctggcggcgccgctcggcatctcgctgccggtctatccggtgaagggctattcgatcacggtgccgatcaaggacgcttccggcgcgccggaatcgaccgtgatggacgagagctacaaggtcgcgatcacccgcctcggcaatcgcatccgggtcggtggcaccgcggaaatctccggctattcggacaagctctacgatgcgcgccgcgccacgctcgatcattcgctgaccgacctgttcccgcgcggcggcgatctcgccaaggcgacgttctggagcggcctgcgcccgatgacgccggacggcccgcccgtgatcggcccgacgcaatatgccaacctccacctcaacaccggccacggcacgctgggctggaccatgtcctgcggctcgggccgcgtgctcgccgacatgctgtcgggcaggaagccggagatcgacgtgagtgcgctgtcggtggagcgatacaagcaccggttcggctaa

SEQ ID NO: 408 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPVMWVWLLKMLRNCTSARYAVNKSRMIPIAEYSRDALRDLRRQIGIQYDERSQGTLQLFRYQAQLDGTAEDIAVLKQYGVPFEVLSREGCIAVEPALGGVKEKFVGGLRLPQDETGDCHMFTQSLAKHAQALGVRFMFNTSIDRIVTEGARVSGVATSAGLLQADAYVLALGSWSSRLAAPLGISLPVYPVKGYSITVPIKDASGAPESTVMDESYKVAITRLGNRIRVGGTAEISGYSDKLYDARRATLDHSLTDLFPRGGDLAKATFWSGLRPMTPDGPPVIGPTQYANLHLNTGHGTLGWTMSCGSGRVLADMLSGRKPEIDVSALSVERYKHRFG

SEQ ID NO: 409 - DNA, 1260 bp, Unknown
  Obtained from environmental sample
atgagcaagcacgtggtcattgttggcgcaggcgtcattggcctttccaccgcgtattattgcgcgcgccgtggcttcaatgtcaccgtcatcgagcgcaaaggcgcgcagcgcgacggcacatcgttcggcaacgcgggcatggtcgtgccgagtcatttcattccgctcgccgcgccgggcatggtggcgctcggcttgaaatggatgtggaatccagcgtcgccgttctacatcaagccccgtttcgatgcggcgttgctggattggggacacaaattttggcgcgccgccacacccgctcacgtgcaacgttccgcgccgctgatccgcgatctttcgtttgccagtcgcgcgtgttttgaagaattcgccgccttgcctagcgcgaattttgattttgtgacgaagggtttgctcatgttgtgccagaccgagcacgcgttgcatgaagagggcaagactgctgaacaggcacgggcgctcggtgttccggcggaagtgctcgacgcgaagcagaccgccgcgctcgactccggtgcgacgatgaagatcgccggctcggtttattttccgaaggactgtcatctttcgccggcaaaattcatggcgctgctgcaatccgaactggaaaagctcggcgtgaaattcgtttgggacagcgacgtcgtaaattggcagatcgaagcaggcaataaaatccgcgcggccaaactgagcaacggccaactaatcaaaggcgatgaattcgtgctgtgcggcggctcgtggtcgccgcaactcgccgagaaactcgcgctcaatatcccgatgcaggcgggcaaaggttacagtctcacgctgccgaagccgcgccaatcattgcagctctgctccatcctctgcgaagcacgcgttgccgtgacgccgatgggcgagacgttgcgcgtcggcggcacaatggaaatcgcaggtctcaacgaagacatcagtccggtgcgcgtgcggggcatcatcgattcgttctgccgctattatcccgagttcaagccgtcagatttcgacgcggtgcaaccgtggcgcggactgcggccctgttcgccagacggtttgccgtatgtcggacgcacggaaaattttgccaacctctcgctctgcaccggtcacgcgatgatgggcctgagccttggcccggtgagcggcaagttgatggcggaagttctcgccggtgaaaaaccgtcgcacgacctcacgctgctttctccggatcgttacaactga

SEQ ID NO: 410 - protein, 419 aa, Unknown
  Obtained from environmental sample
  DOMAIN (4)...(400): FAD dependent oxidoreductase
  SITE (27)...(30): N-glycosylation site. Prosite id = PS00001
  SITE (380)...(383): N-glycosylation site. Prosite id = PS00001
MSKHVVIVGAGVIGLSTAYYCARRGFNVTVIERKGAQRDGTSFGNAGMVVPSHFIPLAAPGMVALGLKWMWNPASPFYIKPRFDAALLDWGHKFWRAATPAHVQRSAPLIRDLSFASRACFEEFAALPSANFDFVTKGLLMLCQTEHALHEEGKTAEQARALGVPAEVLDAKQTAALDSGATMKIAGSVYFPKDCHLSPAKFMALLQSELEKLGVKFVWDSDVVNWQIEAGNKIRAAKLSNGQLIKGDEFVLCGGSWSPQLAEKLALNIPMQAGKGYSLTLPKPRQSLQLCSILCEARVAVTPMGETLRVGGTMEIAGLNEDISPVRVRGIIDSFCRYYPEFKPSDFDAVQPWRGLRPCSPDGLPYVGRTENFANLSLCTGHAMMGLSLGPVSGKLMAEVLAGEKPSHDLTLLSPDRYN

SEQ ID NO: 411 - DNA, 1239 bp, Unknown
  Obtained from environmental sample
atgaaacttgaaggactatcgttgatcggtggaaagcccggcgcgcggggcgggaaaatttttaccggcgtgaatcccgccacgggcgcgacattgccgggagaatttcactctgcttccgtggccgaagccgatgccgcggtgaaactggcgagtgaagcctttgccagttatgcacgatggtctggaaaacaacgcgcggcgttactcaatcgcaccgcagaattactggaagccaatgccgcgctcatcgtcgaacgcggcggactagaaacaggcctgcccgccgcgcgattgcaaggggagctggcgcggacgtgtttccagttgcgtttctatggcgaagcggcgggaagtggattagtggcgggtgcccggatcgatcatgcggatccaaaccgcaagccgctcccgaagcctgacctgcgctccgtgatgattccgctcggaccggtggtggtttttggcgcgagcaatttcccgctcgcctattccgtggcgggcggcgacacagcctccgcgctcgccgcaggttgtcccgtcatcttcaaggcacatccggcccatccgggtctttcggaaatcgtcggtcaactggtgacgcaagccgtgaaagaatccggcgctccggaaggattgttttccctgctgttcgatgccggccatgaagtgggcggcgcattggtgaaacatccgctcgtgaaagctgtcggcttcaccggctcgcggcaaggcggacggacattgatggatctggcggcagcgcggccggagccgattccggtttatgcggagatgggcagtgtgaatcccgtattcatcctttccgaagccttgaacacgaaggcggaagagatcgccgcgggcctgcacggttccgtaacgttgggcgtcggacaattctgcacgaatccaggactcgtctttgtcgaggcgggcgcgggtgcaaaatcatttctcaccaagctggaaacgctgatccaatccacaccagcgggcacgatgttgactgcgggcttgtgtgcggcttatcagcgcggcgtaaaaattttctctgctgtaacgggcgtcaaatccagcggcacgattttgccggacgccagcgctggcgccgctcaggccaacgccgcactttttgtcaccagcgcggaaacatttctgagcaaccatcgcttgatggacgaagtgttcgggccttcgacgctggtggtcgagtgcgcctcgcgcgaacaattcttt

SEQ ID NO: 412 - protein, 413 aa, Unknown
  Obtained from environmental sample
  DOMAIN (12)...(413): Aldehyde dehydrogenase family
  SITE (72)...(75): N-glycosylation site. Prosite id = PS00001
MKLEGLSLIGGKPGARGGKIFTGVNPATGATLPGEFHSASVAEADAAVKLASEAFASYARWSGKQRAALLNRTAELLEANAALIVERGGLETGLPAARLQGELARTCFQLRFYGEAAGSGLVAGARIDHADPNRKPLPKPDLRSVMIPLGPVVVFGASNFPLAYSVAGGDTASALAAGCPVIFKAHPAHPGLSEIVGQLVTQAVKESGAPEGLFSLLFDAGHEVGGALVKHPLVKAVGFTGSRQGGRTLMDLAAARPEPIPVYAEMGSVNPVFILSEALNTKAEEIAAGLHGSVTLGVGQFCTNPGLVFVEAGAGAKSFLTKLETLIQSTPAGTMLTAGLCAAYQRGVKIFSAVTGVKSSGTILPDASAGAAQANAALFVTSAETFLSNHRLMDEVFGPSTLVVECASREQFF

SEQ ID NO: 413 - DNA, 1248 bp, Unknown
  Obtained from environmental sample
gtggcacgtaccgatgcgatggtcctcggcgccggcattgtcggcacatcggttgccctgcatctcgccaaacgcggtctgagtgtcgccttggtcgaccgcgcgggcatcggcgagcagacgtcctatggcaacgccggcatcatcgaaggcaacacgatattcccgccggcatttccatccgatctcggcgcgttgttacggatcgccttcaagcgcgcgagcgaggccaactatcatttgtcctttctgcctcggattctgccctggttgctggcgttccgcgccgcttcgcaacccgaacgtctggccgaaacggcgcggctgatccgtccgttgttttcccgtgcagtggccgaacacgaagcgttgatggccgaggccggtgcgacacactacttgcgcaagacaggctggttgaaggtttatcgcggcgacaggagtttcgccgccctgtcgcctgagttcgatctggctgccaaatttaatttgccgctcaaggtcctcgatacggccgacgcgcaagcgcttgagccatcccttagtccggttttttcgcatgcggtgttctggccggaagcagccagcgtcagcagtcctctcggtgtgacgggcgcctatgccaaacgctttatcgccctcggcggcatcattgtttcaggcgatgcccagtcgctgcatcggagcggtaaaaattggcgggtggaaaccaacgaaggtgcgcttgacgcagcgcagtgcgtggttgcgctcgggccatgggcggtggatttgctggaccgccttggtctgagactgccgcttgcggtgaagcgcggctatcaccgccattttcgcgctgagggcaatgccggcttggcgcggccggtgcttgacgccgaagtgggctatttgatgaccccgatggagcagggcatccgcatcaccaccggcgccgaattcgccgcgcgcgatgcgccgccgaccccggttcagttttcacgcattacgcctcgggcccgcgaactctttcccttgggcgaaatggccgagaacaggacatggctcgggagccggccgtgctttcccgattcgcgtccggtgatcggtcccgcgcccggacttgccggtctgtggctggcaatcggtcatgcccactggggactcacgcttggtcccgcgacgggccgcctgatcaccgagatgatggcgggcgagcagcccttctgcgatccggcgccgtatcgggcgaatcgtttcaatcagtga

SEQ ID NO: 414 - protein, 415 aa, Unknown
  Obtained from environmental sample
  DOMAIN (5)...(395): FAD dependent oxidoreductase
  SITE (350)...(353): N-glycosylation site. Prosite id = PS00001
MARTDAMVLGAGIVGTSVALHLAKRGLSVALVDRAGIGEQTSYGNAGIIEGNTIFPPAFPSDLGALLRIAFKRASEANYHLSFLPRILPWLLAFRAASQPERLAETARLIRPLFSRAVAEHEALMAEAGATHYLRKTGWLKVYRGDRSFAALSPEFDLAAKFNLPLKVLDTADAQALEPSLSPVFSHAVFWPEAASVSSPLGVTGAYAKRFIALGGIIVSGDAQSLHRSGKNWRVETNEGALDAAQCVVALGPWAVDLLDRLGLRLPLAVKRGYHRHFRAEGNAGLARPVLDAEVGYLMTPMEQGIRITTGAEFAARDAPPTPVQFSRITPRARELFPLGEMAENRTWLGSRPCFPDSRPVIGPAPGLAGLWLAIGHAHWGLTLGPATGRLITEMMAGEQPFCDPAPYRANRFNQ

SEQ ID NO: 415 - DNA, 1242 bp, Unknown
  Obtained from environmental sample
atgagcaaagatgtcatcgtcctcggcgccggcatggtcggcgtatcaacggcgctgcaccttcagcagcgtggccgttcggtagcgctcgtcgatcggcgcggcgtggccgaggaaacgtcgtacggcaacgccggcatcattcagcgcgaggggatcgttccctatctctttccgcgcgattgggcgaccatccttcgccatgcacgcaaccagtcgacggaagtgtccttccaatggtcgtcgctgccgagcgtcgcgccgtggatgttcaagtattggagctggtcgaccgaagaggggatgcacgcgaccgcgcgcgccatggcgccgatcgtgacgcgctgcgtcgatgagcacgagcacctcatgaacgaggccggcgtcatcggcatgatccgcaggacaggctacctgcgcctctatcgcaacgagcaggggctcgagaaggccatccacgaggacaatcaggtcaaggccaagtacggcgtcgtttcgcagccgatcgatcgcgccggcctcgccgagatggagccacacctgaagcccatttacgtcggcggcatcttcctgcccgatccctgcagcgttgccgatccgagtgcgctcggcaaggcttacggcgatctcttcgtgcggcgtggcggcgctctggtcgagggcgaggcacgctcactgacgcgcgacggtgccggctggaaggtcgcgacgcgcgacggctggatctcggcgcccgatgtcgtcgtggcgctggggccatggtcagacatggtgacacgcgcgcaggggctcaagctgccgctcggcgtgaagcgcggctatcacatgcactatcatgccgagggcaatgcgacgctcaacaggccggtcatcgacacgtcgatcggttatgcgatggcgccgatgagcaaaggaatccgtgtcaccacgggcgccgagttcgcgacgcgcgacgcgccgccgaaccccgtgcagctcgagcgcgtcgagcctttcgcccgcgccgcgttcccgctcgcggagcgtgccgaggcggcgccctggctcgggcggcgcccctgcttcccggacatgctgccggtcatcggtcaggccgccagcaagaaaggcctctggatgaacttcggccaccaccatctgggtttcacgctcggacccgtgacgggtcgcctgctggccgagatgatgacgggcgagaagccgttcacggaccctcatccctatcgcgcggaacggttctga

SEQ ID NO: 416 - protein, 413 aa, Unknown
  Obtained from environmental sample
  DOMAIN (4)...(395): FAD dependent oxidoreductase
  SITE (72)...(75): N-glycosylation site. Prosite id = PS00001
  SITE (287)...(290): N-glycosylation site. Prosite id = PS00001
MSKDVIVLGAGMVGVSTALHLQQRGRSVALVDRRGVAEETSYGNAGIIQREGIVPYLFPRDWATILRHARNQSTEVSFQWSSLPSVAPWMFKYWSWSTEEGMHATARAMAPIVTRCVDEHEHLMNEAGVIGMIRRTGYLRLYRNEQGLEKAIHEDNQVKAKYGVVSQPIDRAGLAEMEPHLKPIYVGGIFLPDPCSVADPSALGKAYGDLFVRRGGALVEGEARSLTRDGAGWKVATRDGWISAPDVVVALGPWSDMVTRAQGLKLPLGVKRGYHMHYHAEGNATLNRPVIDTSIGYAMAPMSKGIRVTTGAEFATRDAPPNPVQLERVEPFARAAFPLAERAEAAPWLGRRPCFPDMLPVIGQAASKKGLWMNFGHHHLGFTLGPVTGRLLAEMMTGEKPFTDPHPYRAERF

SEQ ID NO: 417 - DNA, 1248 bp, Unknown
  Obtained from environmental sample
atgaagattaccattctgggcgcgggcgtcatcggcgtgacctcggcctattatctcgcgcgcgccggtcacgaggtgacggtcctcgatcgccagccgggcagcgcgctggaaacgagctttgccaatgccggcgaaatctcgccgggctacgcttcgccatgggctgcccccggtatcccgctcaaggccttgaaatggctgttcatgcagcacgcgccgctgatcatccgtccgatggcggaccgtgccacctggtcgtggatgctggagatgctgcgcaactgcacgtcggcccgctatgccgtcaacaaagggcgcatggtcaggctcgccgaatacagccgcgactgcctcatcgcgcttcgcgaggaaaccggcatcgcctacgaccatcgctgccaggggacgctgcagctcttccgtacgcagaagcagctcgattcgatcggcaaggacatcgacgtgctgcgcgccgacggcgtgcccttcgaagtgcttgatgtcgccggctgcgttgctgcggagcccggcctggcctcatcgcgcgacaagatcgtcggcggcctgcgcctgcccaatgacgagaccggcgactgctacaagttcacgaccgcgcttcagaagcatgccgaagccctgggcgtgcggttccgcttcggcgtcggcatccgcggcctcaaccgtcagggcgaccggatcgaatcgctttcgaccgaccagggcgacatcgtctcggacgttttcgtggcggcgctgggcagctacacgcccgctctcctcgagccgctcggcatcgacctgccggtctacccggtcaagggctactcgatcaccgtgccgatcgtcgacgaatcccgtgcgcccgtctccacaatcatggacgaaaccttcaagatcgccattacccgtctcggcgaccggatccgcgtcgggggtatggccgagatcgccggcttcagccacgatctgccggctgcccggcgggcgacgctcgaacattcggtcgaggacctgttcgggggtgccggcgaccagagccgcgcgaccttctggtccgggctccgtccgatgacgcctgatggtacgccggtgatcggctccacccgctacggcaatcttttcatcaatgccggccacggcacgctcggctggacgatggcctgcggttccggtcgcgttctggcatcattgatcggcggcaaagcgcctgaaatacgcgccgacgatctcggcctcgtgcgctag

SEQ ID NO: 418 - protein, 415 aa, Unknown
  Obtained from environmental sample
  SIGNAL (1)...(20)
  DOMAIN (2)...(398): FAD dependent oxidoreductase
  SITE (96)...(99): N-glycosylation site. Prosite id = PS00001
MKITILGAGVIGVTSAYYLARAGHEVTVLDRQPGSALETSFANAGEISPGYASPWAAPGIPLKALKWLFMQHAPLIIRPMADRATWSWMLEMLRNCTSARYAVNKGRMVRLAEYSRDCLIALREETGIAYDHRCQGTLQLFRTQKQLDSIGKDIDVLRADGVPFEVLDVAGCVAAEPGLASSRDKIVGGLRLPNDETGDCYKFTTALQKHAEALGVRFRFGVGIRGLNRQGDRIESLSTDQGDIVSDVFVAALGSYTPALLEPLGIDLPVYPVKGYSITVPIVDESRAPVSTIMDETFKIAITRLGDRIRVGGMAEIAGFSHDLPAARRATLEHSVEDLFGGAGDQSRATFWSGLRPMTPDGTPVIGSTRYGNLFINAGHGTLGWTMACGSGRVLASLIGGKAPEIRADDLGLVR

SEQ ID NO: 419 - DNA, 1326 bp, Unknown
  Obtained from environmental sample
atgaaagttcttgtcctcggcgccggcatcatcggcaccagcaccgcctggcacctgctcgagcgcggccacgaagtcaccgtggtcgaccgccaggacgccgccgcgcgcgaaaccagcttcgccaacgcgggccagatctccgtgagctactgcgagccctgggccaaccgccacgcgccggccaagctgctgaagtggatgttccgcaacgacgcgccgctgctgttccgcccgcagctcgattggcagcaatggcgctggggcctggagttcctcgcgcaatgcaacgacacggcgttcgagcgcaacgtgaagcagctggtggcgctcggaagctacagccacgccgcgctgaaggacgtggtccgcgccaccggcatcgaataccagcggctcgaacgcggcatcgcccactacttcaccgacgcgaaatcattcgaggaagccggacgcgccgccgaactgatgcagcgcttcggtgtcgagcgcaaggtcgtgtcgcgcgaagagctccttcgcatcgaacccgcgttcgcgcagtttgcgcatgagatggcgggcggcacctacaccgccagcgacgaaagcggcgatgcacgcctgttcacggagcaactggccgctcgctgcgccgcgcacggcgcccagttcctgtacgaacacgacatcgatcagctggaagtcgccggccgcgaggtctcggcggtgcgtgtgcgcgaccgcatcgccggcacggagcggcatcttcaggccgacgcggtggtggtggcgtgcggctcctacaccgcgcccctgctgcgcaccgtgggtgtggacctgccgatctacccgggcaagggctacagcgccacgttccgcatcaacaagccggaactcgccccgtacgtgagcacgatcgacgacgaggtcaaggtggcgatgagccgcttcggcgacgaactgcgcgtggccggcacgatcgagctggccggcttcgaccggtcgctcgactcgccgattgcccgcgcgcgctgccgcatgctggccgaccggatcgagaaggtgctgcccggcgtgtgcgacacgcgcaccgaggaagaaggcggcaccccgcgcttctggacgggcctgcgccctgccacgccgacgaacatcccatacatcggccgcacgcgcgtcggcaaactgtgggtcaacgccggccacggcacgctcggctggacgcacggcgcgggctcaggcaaggcgatcgccgagctgatcagcggcgagcagcccgccacggagttcaacttctacggcttcgagaagagcgctcagcgctactcaccgagcccggcctga

SEQ ID NO: 420 - protein, 441 aa, Unknown
  Obtained from environmental sample
  DOMAIN (2)...(414): FAD dependent oxidoreductase
  SITE (98)...(101): N-glycosylation site. Prosite id = PS00001
MKVLVLGAGIIGTSTAWHLLERGHEVTVVDRQDAAARETSFANAGQISVSYCEPWANRHAPAKLLKWMFRNDAPLLFRPQLDWQQWRWGLEFLAQCNDTAFERNVKQLVALGSYSHAALKDVVRATGIEYQRLERGIAHYFTDAKSFEEAGRAAELMQRFGVERKVVSREELLRIEPAFAQFAHEMAGGTYTASDESGDARLFTEQLAARCAAHGAQFLYEHDIDQLEVAGREVSAVRVRDRIAGTERHLQADAVVVACGSYTAPLLRTVGVDLPIYPGKGYSATFRINKPELAPYVSTIDDEVKVAMSRFGDELRVAGTIELAGFDRSLDSPIARARCRMLADRIEKVLPGVCDTRTEEEGGTPRFWTGLRPATPTNIPYIGRTRVGKLWVNAGHGTLGWTHGAGSGKAIAELISGEQPATEFNFYGFEKSAQRYSPSPA

SEQ ID NO: 421 - DNA, 1293 bp, Unknown
  Obtained from environmental sample
atgagcgcggcctcgtcgcctgctgctgagcgccgcatcccgccgctcgacccgtcgggccaggtcgcggtcatcggcgcgggcgtcgtcggcctgtcgaccgcgctgctgctggcccgcgcgggcgtgcccacgacggtgctcgagcgcggccaggtcgccgcgggcgcgtcatggggcaacgccgggttcctcactcccgcgttgaccacgcccctgccgcagccgtcgatgctgcgcaccggcatcaaggcgctgatcagcccacgctcaccgctgtacgtgccgttcaggctcgacccgcggctgtggtcgttccttgtagagctcgcccgccattgcacgaaccgcgcctggaccgcctcgatgcaggcctacgcgccgctggtgcgtgcgagcctgggcgccttcgacgagatcgtcgacgcgggggtgaccgacgtcgttcgcacgcccgagatcatcgtggcggcatgccgcgaggccgccgcgcgtgatcacgtcgtcgacgacctcgaggccgtgcggcacgcgggcatcgacgtcgacttcgagctgctcgaccggtcggcactgtcggccgtcgcgcctcacgtcggtccggcgatcacctcaggggtcgcggtccgcggccagcgcaccatcgacccacgccgcttcatggatcgtctggccgaggcggccacggcggccggggtgcaggtgcgcaccggcaccgaggtggtcgcgctgcgtgacgacggccggaaggtcgcggtcgatctcgccggcgacgagacgctgaccgtcgaggccgcggtggtggccaccggcgccgagctggccgcgctcgtgggaggcttcggggtgcgccggagggtgcacgccggccgcggctactcgttcagcgtggcctcggccatcgacgtgcccacctcgacgtggttcccgtccgacaagatcgtggccaccccgctcgacgacggcaggctgcgcatcgcaggcatgatggaattccgccggcacggcgatccgatcgacccccgtcgcatcgcggcggtcgccgacgcggcccgcggggtgctgccggcgttcgacgtcgacgatcggcgcgaggaatgggtgggctcacggccggtgaccgctgacggccggccgctgatcggcccgacctcctcgccacggatcatcgccgccggcggccacggcatgtggggagtcgtgctcgggccgctgaccggccggctcgtcaccaggatgctcgtcgacgggacggtggccagcgagctcgcacccttcgatccgctgcgctga

SEQ ID NO: 422 - protein, 430 aa, Unknown
  Obtained from environmental sample
  DOMAIN (21)...(413): FAD dependent oxidoreductase
MSAASSPAAERRIPPLDPSGQVAVIGAGVVGLSTALLLARAGVPTTVLERGQVAAGASWGNAGFLTPALTTPLPQPSMLRTGIKALISPRSPLYVPFRLDPRLWSFLVELARHCTNRAWTASMQAYAPLVRASLGAFDEIVDAGVTDVVRTPEIIVAACREAAARDHVVDDLEAVRHAGIDVDFELLDRSALSAVAPHVGPAITSGVAVRGQRTIDPRRFMDRLAEAATAAGVQVRTGTEVVALRDDGRKVAVDLAGDETLTVEAAVVATGAELAALVGGFGVRRRVHAGRGYSFSVASAIDVPTSTWFPSDKIVATPLDDGRLRIAGMMEFRRHGDPIDPRRIAAVADAARGVLPAFDVDDRREEWVGSRPVTADGRPLIGPTSSPRIIAAGGHGMWGVVLGPLTGRLVTRMLVDGTVASELAPFDPLR

SEQ ID NO: 423 - DNA, 1245 bp, Unknown
  Obtained from environmental sample
atgagtaatgttacaatagtcggcggtggcgtcattggtctttgcactgcctactatcttcgaaaagcaggtcaccaggtcacagttattgagaggaacgatattaccgatggttgttctttcgggaacatgggatatatctctccttcgcattttatcccgctcgccactccgggtattgtcaaacagggattaaaatggatgacgagttcctcttctcctttctatatcaaaccaagactgaactgggatcttattcgctggggaacgacattctggagaaaggccaatgcgaacacagtcgaaaaaaacataccccatctcaataacctgttgcagttaagccgcagactgatgaatgatctcgtaaaagaacttccgggttcatttgatatgaccgagaaaggctgctggatgttatataagaatgaaaagaccggtgatcacgagaagcatttagccgagcaggcgcattcactgggtttaaagaccattacttgtaatgcggcagaagtgcagcagcgcgaaacacaggtggaagtaaatgtagccggcggcgtattatacctggacgattgccatatcgattcatcgaagttcatgcgatcattgtatagttaccttcaaaagatcggtgtgaagttctggctgaatacaagcgtgacgggttttgaaaaagaaaatggtcgcattactgctgttattaccgataaaggagaattctattgtgaagaactggtcatagcgaatggttcctggatgggagagatatcaaaactattaggtataaagatgatgatacagccgggaaagggatacagtatcgtgtatactgatcttgcaaagaacctgcagtatccgtctattctcgtagatgaccgtactgctactacacccatcaaccaatggctacgtatcggtggaacgatggaattgagtggtcatagtgataatatccttcctaaaagagtaatggctatctataatgctttcaataagtattatccgaagatggatcttccgcaaccggatatttcaaaagcctggtatgggtaccgcccggttacgccggatggaatgccgtatatcgggagacatagcaaatacagcaatctcacttatgcaggtggacatgcaatgctgggtgtaagtgcggctgcaggaacggctttattgatcaaggaaattctttccaatgaaccggctacgattgaactcggagcatttgatcccggacgattctaa

SEQ ID NO: 424 - protein, 414 aa, Unknown
  Obtained from environmental sample
  DOMAIN (3)...(396): FAD dependent oxidoreductase
  SITE (3)...(6): N-glycosylation site. Prosite id = PS00001
  SITE (221)...(224): N-glycosylation site. Prosite id = PS00001
  SITE (253)...(256): N-glycosylation site. Prosite id = PS00001
  SITE (376)...(379): N-glycosylation site. Prosite id = PS00001
MSNVTIVGGGVIGLCTAYYLRKAGHQVTVIERNDITDGCSFGNMGYISPSHFIPLATPGIVKQGLKWMTSSSSPFYIKPRLNWDLIRWGTTFWRKANANTVEKNIPHLNNLLQLSRRLMNDLVKELPGSFDMTEKGCWMLYKNEKTGDHEKHLAEQAHSLGLKTITCNAAEVQQRETQVEVNVAGGVLYLDDCHIDSSKFMRSLYSYLQKIGVKFWLNTSVTGFEKENGRITAVITDKGEFYCEELVIANGSWMGEISKLLGIKMMIQPGKGYSIVYTDLAKNLQYPSILVDDRTATTPINQWLRIGGTMELSGHSDNILPKRVMAIYNAFNKYYPKMDLPQPDISKAWYGYRPVTPDGMPYIGRHSKYSNLTYAGGHAMLGVSAAAGTALLIKEILSNEPATIELGAFDPGRF

SEQ ID NO: 425 - DNA, 1260 bp, Unknown
  Obtained from environmental sample
atggcgcaacggattgaggaggccgaggttctggtgctcggcgccggcatcgtcggcgtctccatcgccctgcatctgcaaatgcgcggccgcgccacgctgctgctcgaccgtcaggggccgggggagggcacctccttcggcaatgccgggctcatccagcgagaggcagtgtttccgcatctctttccccgtcatccgggggacctgctgcggtatgccttcaatctcaagaccgaagcgcattatcaggcgcggatgctgccgcagctcgcgcggcccttcgcccgctactggtaccattccgagccgcgccgctacctggccctgtcccgccattacgagcggctcatcgcccattgcgtgagcgatcatcaggcgctggcggaggctgccggcgcgatggatctcctccgccccggcggctggaccatggtgcaccggacggcacgcagctttgcccacacgctgaaggaagcggagctcgcgaagcgagaattcggcgtggactatgccgtttgggatgcggctgaactcgcccggcaggagccgcatctggcccaaggtctcgccggcggcctgcattggacgcagccggtggcggtgctcgatccccatgccctgaccctcgcctatacggcgctgttcgagcgcctgggcgggcgggtgatgcgcgccgacgcccggcacctcgagcggccgggcggcgcctgggaggtggcggcgcctggggtggtggtgcgcgcgcctgcggcggtcgtggcactcggcgcctggtccccagaggtgacgaagccgctcggctacgatccgccgctcttcatcaagcgcggctatcacatgcactatcagcccgccggtaatgcgggcttggcgcatccggtcttcgatgtgtcggccggctacatgctggcgcccatgcgccgtggcatccgcctcaccaccggcgcgcaattcgtcgaccgcgatgcaccgcccaatcccgtccagctcgaccgggtggagcctctggcgcgccatctgctgcctggcctaggcaaccgattggacgacgcaccctggttcggtgcgcggccctgcacgcccgacatgctgcccatcatcggcccggcacccaggcagccgggcctctggttcggcttcggccacgggcatcagggcctcacgctcggccccaccacgggccgcatgctggccgccatgatggcgggagacgcgcccttcacagaccctgcgcccttccgccctgagcgattttga

SEQ ID NO: 426 - protein, 419 aa, Unknown
  Obtained from environmental sample
  DOMAIN (9)...(401): FAD dependent oxidoreductase
MAQRIEEAEVLVLGAGIVGVSIALHLQMRGRATLLLDRQGPGEGTSFGNAGLIQREAVFPHLFPRHPGDLLRYAFNLKTEAHYQARMLPQLARPFARYWYHSEPRRYLALSRHYERLIAHCVSDHQALAEAAGAMDLLRPGGWTMVHRTARSFAHTLKEAELAKREFGVDYAVWDAAELARQEPHLAQGLAGGLHWTQPVAVLDPHALTLAYTALFERLGGRVMRADARHLERPGGAWEVAAPGVVVRAPAAVVALGAWSPEVTKPLGYDPPLFIKRGYHMHYQPAGNAGLAHPVFDVSAGYMLAPMRRGIRLTTGAQFVDRDAPPNPVQLDRVEPLARHLLPGLGNRLDDAPWFGARPCTPDMLPIIGPAPRQPGLWFGFGHGHQGLTLGPTTGRMLAAMMAGDAPFTDPAPFRPERF

SEQ ID NO: 427 - DNA, 1254 bp, Unknown
  Obtained from environmental sample
atggcggaactgaaggccgacgtactcgttctgggtgcgggcatggttggcgtgagcgtcgccttgcacctgcagaagcgcggccgcggcgtggttctgatcgaccggcacgaggtcgccggtgaggaaaccagttacggcaatggcgggttgatcgagtgcgcctcggttttcccctacatgtttccacgcgacctcggccagatcctgcgctacgcgtttcttcgtgcgccgcaggtgcagtaccatttcagggatctgcccgtcttcctgccgtggctgacaaagtatttcctcgcctcgtcgccgcagcgcgcgctgaacagcgcgatggccgaactgccgctgatccagcgcagcctgatcgagcatgaagcgctgatcgcggaagccaatgtgcccgagcttttgcgccggatcggctggatcaagctgttccgttccgagaaaacgcttgcggctgcgatgggcgagttgaagcgggccgggcagtatggcgtcaccggtgacatcctggatacggccgcgatcctggcgcgcgagccgcatctgaccggggatttcagcggcgccatccattttccggcgccgggcttcgtgccggaccccggcggcttggccaaggcctattcggcgctgttcggccgcaagggcgggcggtatctcgtcggcgatgcgcgcacgctcgaacagtccggcacccgctggcgggtggcgacgatggaaggcaccatcacggcgcgggacgtcgtggtggcgatgggaccctggtcggaccagattttcgcgccgctcggctattcgatcccgctacaggtcaagcgtggttaccatttgcacctcaagccgcgcggcaacgcggtcctgaatcatcccgtgctggacaccgatctcggctatctgctggcgccgatgaaccgcggcattcgcctgaccaccggcgccgagtttgcccaccgcgacgcgccgccgacgccggtccaggtcgagcgttccctgccaagggcgcaccggctgttcccgctgggcgagccagtcgataccaagccctggatgggggcgcggccctgtttgcccgatatgctgccggtgatcggcaaggcgccccgccatagcgggctgtggttcgatttcggccaccagcaccacggtctgacgctcgggcccgcgaccggccgcctgctggccgagatgatgaccggcgagaccccgtttgccgatcacaggccctttgccgtcgaacgttttggttga

SEQ ID NO: 428 - protein, 417 aa, Unknown
  Obtained from environmental sample
  DOMAIN (7)...(398): FAD dependent oxidoreductase
MAELKADVLVLGAGMVGVSVALHLQKRGRGVVLIDRHEVAGEETSYGNGGLIECASVFPYMFPRDLGQILRYAFLRAPQVQYHFRDLPVFLPWLTKYFLASSPQRALNSAMAELPLIQRSLIEHEALIAEANVPELLRRIGWIKLFRSEKTLAAAMGELKRAGQYGVTGDILDTAAILAREPHLTGDFSGAIHFPAPGFVPDPGGLAKAYSALFGRKGGRYLVGDARTLEQSGTRWRVATMEGTITARDVVVAMGPWSDQIFAPLGYSIPLQVKRGYHLHLKPRGNAVLNHPVLDTDLGYLLAPMNRGIRLTTGAEFAHRDAPPTPVQVERSLPRAHRLFPLGEPVDTKPWMGARPCLPDMLPVIGKAPRHSGLWFDFGHQHHGLTLGPATGRLLAEMMTGETPFADHRPFAVERFG

SEQ ID NO: 429 - DNA, 1263 bp, Unknown
  Obtained from environmental sample
atgaacgaaccaaacaacaatttcgacgtaatcataatcggcggcggggtgattggcctttgctgtgcttattatttgaataaggcgggctgtcgggtggcactgctggagaagggcgacctgggcagcggcagttcgagcggtaatgcggggctgattgtgcctagtcattttattccgctggcggcgccgggggtggtggggcaagggttgaagtggatgctcgacccggaaagccctttttacatcaagcctcggctgaatggggatctgctgcgctggctgtggcagtttcggcgagcgagtacgcaagcgcatgttgagcggagtatgccgctgctgctggagatgcatttagccagtttggctttgtatgagcagttggcaggcgagttggattttgggttggtgcaggaggggctgttgatgttgtacaaaacggccgttggtgaagccgaatgtactgaactggttgaaaccgcccatcaactagatttagcggcagaattgttcgacgcggcgcaggtgggcgcgatgctgtctgggctggacgtgacggtggcgggtggcgcgtattttcctcgggatggacatttaaacccagggcagttattggctggattgcgtgaggttttggtgcaagctggcgtggcaatttttacgcagactgaggtattgggcttggtggcgaatggggaaaggatagccagcgtttctactacaaaaggcatgtttacggctgatgagattgtattggcaggtggctcctggtcgccgaatgtggtgcgggatttgggggtgcgtttgcccattcaagcggccaaagggtacagcttcatggcaccgcagttggcgggcaaactgactgtgccgctgctgctcacggatgccaaggtggcggtgacgccgttggcggagggcattcgctttgcggggacgttggagatgacggggctggatgtggcggtcaaccagcggcgggtggcggcgatgcgccgcgcggtgcctgattatttgccggcgtttgcgttggcggaggaaccgattagcgagatgggtgtgtgggctggtttacgcccctgttcaccggatggcttgcccatcattgggcgggatacaaacgttagcaacctgattctggcgacgggccatgccatgatgggggtttcattggcgccgattacgggcaagttggtggctgagattgtggcgggggaagcgagttcgattgaattgggaatgttagcgaaaaacaggttttga

SEQ ID NO: 430 - protein, 420 aa, Unknown
  Obtained from environmental sample
  DOMAIN (9)...(402): FAD dependent oxidoreductase
  SITE (379)...(382): N-glycosylation site. Prosite id = PS00001
MNEPNNNFDVIIIGGGVIGLCCAYYLNKAGCRVALLEKGDLGSGSSSGNAGLIVPSHFIPLAAPGVVGQGLKWMLDPESPFYIKPRLNGDLLRWLWQFRRASTQAHVERSMPLLLEMHLASLALYEQLAGELDFGLVQEGLLMLYKTAVGEAECTELVETAHQLDLAAELFDAAQVGAMLSGLDVTVAGGAYFPRDGHLNPGQLLAGLREVLVQAGVAIFTQTEVLGLVANGERIASVSTTKGMFTADEIVLAGGSWSPNVVRDLGVRLPIQAAKGYSFMAPQLAGKLTVPLLLTDAKVAVTPLAEGIRFAGTLEMTGLDVAVNQRRVAAMRRAVPDYLPAFALAEEPISEMGVWAGLRPCSPDGLPIIGRDTNVSNLILATGHAMMGVSLAPITGKLVAEIVAGEASSIELGMLAKNRF

SEQ ID NO: 431 - DNA, 1242 bp, Unknown
  Obtained from environmental sample
atgagaattggaatcatcggaggaggagtcataggactgtcatcggcttactacctgatgaaggcaggtcatcaggttacggttattgatcaatccggtctgcaggatggatgttcattcggcaatgcaggcatgattgtgccaagccacatcatcccgctggcttcaccgggaatgattgccaagggaattcgctggatgttcaactcaacgagtccgttttatgtgaagccacgcctgagtggcgacctgatcaaatggggctggcaattctacaagcactccacaaaatcgcatattgatcatgctgctcctgcattgaaggaaatcagcctgttgagcaaatctctttaccgcgaattggcgcgggagcttcccttcggtttcggctaccatgagcgaggactgctcatgctctatcagtcaaaggaaacggaacaagaagaaacagaaggcgcagcgtatgcaaacaaactaggcattgaagcgcatgtcctttcaccggatgaagtgcagcaacttgagcccgacatgaaggtgagtgtgcggggcggaatcttttacccgggcgatgcacatatcacaccgcatgcatttgtctctcaaatgctggattatcttcgggaaaaaggagttatcatcaagccagatactaccgttgtagattttgtgactgaaaactcaaagatcacccgggtgatcacggatcagggagattttacttttgatgaggtggtaattgcgaccggctcctggtcgggaatagtggcttcaaaacttggcatgaccttgccaatgcaggcaggtaagggatacagttttacgttacagaatgtcagaaaaaattcaagaataccttccatttttctggaagcccgtgtggcagtcacgccaatgggaacatccttacgcttcgggggcaccatggaaatcacaggaattgatcatgcaatcaacatgaaccgcgtcaggggaattgtagagtccatacccaggtattatcccgaactacgcgttgacattcccaaaaaggaagaggtatggcacggactgcgcccctgttcaccggacggattgccgtatatcggccgttcaaaaagattctcaaacctggttatcgcaaccggtcactccatgatgggactcagtctcggtccgggaaccggcaagctggtgagtgaattgattggtcgtgagaaatcaagcattgatatctctgcttttgatccggacaggttttaa

SEQ ID NO: 432 - protein, 413 aa, Unknown
  Obtained from environmental sample
  DOMAIN (2)...(395): FAD dependent oxidoreductase
  SITE (70)...(73): N-glycosylation site. Prosite id = PS00001
MRIGIIGGGVIGLSSAYYLMKAGHQVTVIDQSGLQDGCSFGNAGMIVPSHIIPLASPGMIAKGIRWMFNSTSPFYVKPRLSGDLIKWGWQFYKHSTKSHIDHAAPALKEISLLSKSLYRELARELPFGFGYHERGLLMLYQSKETEQEETEGAAYANKLGIEAHVLSPDEVQQLEPDMKVSVRGGIFYPGDAHITPHAFVSQMLDYLREKGVIIKPDTTVVDFVTENSKITRVITDQGDFTFDEVVIATGSWSGIVASKLGMTLPMQAGKGYSFTLQNVRKNSRIPSIFLEARVAVTPMGTSLRFGGTMEITGIDHAINMNRVRGIVESIPRYYPELRVDIPKKEEVWHGLRPCSPDGLPYIGRSKRFSNLVIATGHSMMGLSLGPGTGKLVSELIGREKSSIDISAFDPDRF

SEQ ID NO: 433 - DNA, 1245 bp, Unknown
  Obtained from environmental sample
atggcacgtactgatgcaatgattctcggtgccggtatcgttggcacttcgatcgcacttcatctcgccaagcgcgggctcagcgtggcgctggtcgaccgggccggcatcggcgagcagacgtcctatggcaatgccgggatcatcgagggcaacacaatatttccgcccgcatttccgtccagtgtcggcgcgctattgcgcgttgcgttcaagcgtgcaaccgaggccaactatcacctttcttttctgccgaaagttaccccttggctgctggcattccgcgcggcttcccgaccggaaaagctggccgagacggctcagctgatccgtccgctgttttcccgcgcggtcgccgaacacgaagcgctgatggctgaagcgggcgcgacgaaatatctacgcaagaccgggtggctcaaggtctatcgtgacgaaaagagcttcaagtcactcgctgccgagttcgacctggccgccaagttcggtttgccgctccaagctctcgatacagcaggcgcacaggcgctcgaaccgtctctcagtccggtcttcgcgcacggagtattctggccgcaggcggcaagcatcagcaatccgctcggcgttacgcgagcctatgcggcgcattttgcccggctcggcggtgtcttcctgaccggtgatgcgcagacactgcaccgttccggcagtaattggagggtagagacggatcagggcgcgcttgatgcaagtcagtgcgtgatcgcgctcggtccctgggcttcagatctgttgcggcagctaggcatcacgctgccgctcgctgtcaagcgcggttaccaccggcatttccatgcgcagggcaacgcggggctggcgcgcccggtgctggacgccaacgtggggtacctgatcacgccgatggagcaggggatccgtatgacgaccggcgccgagttcgccgcgcgtgacgctcaaccttcgccggtgcagtttgaccgtatcatgccgcaagcccggcaactgttcccgttcggcgaacgagcagacgatagaacctggatgggcagccggccctgcttgcccgactcccggcccgtgatcggccgcgcgcctaggctttccggactatggcttgcggtcggacatgcgcattggggcctaacgcttggcccggcgaccggccgtctcgttgcggaaatgatgacgggggatacaccgttttgtgatccaaccccgtaccgtgccgaacgatttagctag

SEQ ID NO: 434 - protein, 414 aa, Unknown
  Obtained from environmental sample
  DOMAIN (5)...(395): FAD dependent oxidoreductase
  SITE (368)...(380): Lipocalin signature. Prosite id = PS00213
MARTDAMILGAGIVGTSIALHLAKRGLSVALVDRAGIGEQTSYGNAGIIEGNTIFPPAFPSSVGALLRVAFKRATEANYHLSFLPKVTPWLLAFRAASRPEKLAETAQLIRPLFSRAVAEHEALMAEAGATKYLRKTGWLKVYRDEKSFKSLAAEFDLAAKFGLPLQALDTAGAQALEPSLSPVFAHGVFWPQAASISNPLGVTRAYAAHFARLGGVFLTGDAQTLHRSGSNWRVETDQGALDASQCVIALGPWASDLLRQLGITLPLAVKRGYHRHFHAQGNAGLARPVLDANVGYLITPMEQGIRMTTGAEFAARDAQPSPVQFDRIMPQARQLFPFGERADDRTWMGSRPCLPDSRPVIGRAPRLSGLWLAVGHAHWGLTLGPATGRLVAEMMTGDTPFCDPTPYRAERFS

SEQ ID NO: 435 - DNA, 1254 bp, Unknown
  Obtained from environmental sample
atgccaggaaccgttgacgccattgtgcttggcgccggaattgtcggcgtctcggcggcgctcgcgcttgctgagcgcgggcgagcggttgctctgatcgaccgcctgccccacgcggcgggcgagacgagcttcggaaacagcggcatcgttcagaccgagggcgttctcccttacctgttcccgcgcgcaattggcgacatcgccagggcggcgatgaaccgcgatcctcgcgcccatatccgctatggcgcgctgccctcgaccgcgccggcgatctggcgctatttccaggcctcgacgcaagcgagaaagctcgcgaccggcgcaatcatggcgccgctcatggcggcggccgccggcgagcacctgaagttcgctcgagacgccggcgccccggagctcctgcgcccgggcggctggatcaaggcctatcgcagcgagcgcgggcgggagctcgcgcatgacgaggccgaggagctgaagcgcttcggaatcaagcccgcgttcctcgaccgggcgaggctaaccgcgctcgagccgcatgtcggcgagaaggtgatcggcggcgtgcattatacggagccgctgtccacgcccgatccgggcgcgctcatccggagctatgccgcgctgttcctgaagcgcggcggccggatggagaggggcgaggcgctcagcctcgaggcctcgggcgcgggctggacggtcaagaccgattccggtgccctcgccgcccgcgatgtcgtcatcgcgctcgggccgtggtcggaccagctggcgaggcgcttcggcctctcgctccccttcttcgtcaagcgcggctatcacatgcactacgaagccagcggcaatgcggggctcggccgtccggtgctcgatctcgagcggggctatctcgtcaccccgatggctcagggcctgcggctgaccacgggggcggaattcgcccggcgcgacgacccgccgtcggctgcgcatctcgatcggctggagccattcgcgcgggagttgttcccgatcggcgcccggaaggaccccgcgccctggctcggccggcgcccctgcctgcccgacatgcgcccgatcatcgggccgttccccggcaagccgggcctgtggctcgacttcggccaccaccatttggggctcacgctcggccccatcaccgggcggcttctggcggaaatgatctgcggcgaagcgccgcttgtcgatcccgccccgttcaaggcggagcggttcgccgcctga

SEQ ID NO: 436 - protein, 417 aa, Unknown
  Obtained from environmental sample
  DOMAIN (6)...(397): FAD dependent oxidoreductase
MPGTVDAIVLGAGIVGVSAALALAERGRAVALIDRLPHAAGETSFGNSGIVQTEGVLPYLFPRAIGDIARAAMNRDPRAHIRYGALPSTAPAIWRYFQASTQARKLATGAIMAPLMAAAAGEHLKFARDAGAPELLRPGGWIKAYRSERGRELAHDEAEELKRFGIKPAFLDRARLTALEPHVGEKVIGGVHYTEPLSTPDPGALIRSYAALFLKRGGRMERGEALSLEASGAGWTVKTDSGALAARDVVIALGPWSDQLARRFGLSLPFFVKRGYHMHYEASGNAGLGRPVLDLERGYLVTPMAQGLRLTTGAEFARRDDPPSAAHLDRLEPFARELFPIGARKDPAPWLGRRPCLPDMRPIIGPFPGKPGLWLDFGHHHLGLTLGPITGRLLAEMICGEAPLVDPAPFKAERFAA

SEQ ID NO: 437 - DNA, 453 bp, Unknown
  Obtained from environmental sample
atggaactggcagacgaaatcaccatcaatgcgccaaaggacgttgtctacgcggctctgaacgaccctgatatcctccaacaatgcatcccgggttgcgaagagttggtcaagcattccgacaccgaacttgaggccaaggtcgtcctgaaagtcggaccggtgaaagcgcgtttcagcggcaatgttgagttgaacacagatggggcgccggacgcgttttccctttcaggccaaggcaacggcggggcggcgggacacgccaagggcggagcggatgtcacgcttactgctgatggcgacacgaccatactcaaatacgaggcgaaggccgagatcggaggcaagctcgcgcagttgggcagccggttgatacagagcacggccaagaagctagctgccaagttctttggttcctttgcagaggcaatggagaatcagtcggtagcttag

SEQ ID NO: 438 - protein, 150 aa, Unknown
  Obtained from environmental sample
  DOMAIN (5)...(145): Carbon monoxide dehydrogenase subunit G (CoxG)
  SITE (148)...(151): N-glycosylation site. Prosite id = PS00001
MELADEITINAPKDVVYAALNDPDILQQCIPGCEELVKHSDTELEAKVVLKVGPVKARFSGNVELNTDGAPDAFSLSGQGNGGAAGHAKGGADVTLTADGDTTILKYEAKAEIGGKLAQLGSRLIQSTAKKLAAKFFGSFAEAMENQSVA

SEQ ID NO: 439 - DNA, 780 bp, Unknown
  Obtained from environmental sample
atgacccccgccgagatcatcgaaccagaactttcgcaagcggcccgggacctgcgggaccgggatgagccgttttgcttcgcaaccatcgtgcgcacggtcggtgcaacggcggccaagcccggggcgaaggctttgctggcggcggacggaacgatcctcgagggctgggtgggcggcggttgcgccagaggtgccgttaaaagggcagcggcgctggcactcagcacaggcgatccgcaactgatctcggtcgctccggaagaattcctcgccgagatcggggtggaacctggaaccgaacaggacggcgtcacctatgcgcggaatggctgcccatccaagggcactgtcgatattttcgttgagccctgcctgcccataccggaactgatcattcttggcgggtcgccagtggccaaagcactaacccaacttgccccacagtttcattgggcggtgacagcaagttcggacggggccaatctgaccgaaaccaatcggcgccgcttcgtcgttgtcgcgacgcaagggctgggggatctggccgcgctaagggctgcttcggaagtgaaggcggaccatgtctgttttgtaggaagcagtcgaaagttcgccgcgctctcggaacagctggttgaggaaggggcggcgccttccaagctcgctcgcatcaaggcgccagccggcctcgacatcaaagctgtgacaccggaggaaatcgccctctcgatcctcgccgaactcgtccaggtgcgtcggggcgcggtccagtcatga

SEQ ID NO: 440 - protein, 259 aa, Unknown
  Obtained from environmental sample
  DOMAIN (16)...(88): XdhC and CoxI family
  SITE (164)...(167): N-glycosylation site. Prosite id = PS00001
MTPAEIIEPELSQAARDLRDRDEPFCFATIVRTVGATAAKPGAKALLAADGTILEGWVGGGCARGAVKRAAALALSTGDPQLISVAPEEFLAEIGVEPGTEQDGVTYARNGCPSKGTVDIFVEPCLPIPELIILGGSPVAKALTQLAPQFHWAVTASSDGANLTETNRRRFVVVATQGLGDLAALRAASEVKADHVCFVGSSRKFAALSEQLVEEGAAPSKLARIKAPAGLDIKAVTPEEIALSILAELVQVRRGAVQS

SEQ ID NO: 441 - DNA, 1182 bp, Unknown
  Obtained from environmental sample
atgagccgggtgacccgttttgctgcccgtgatcccgggcctgccgcgcgtctctctggcttcgtggcccatctccgagacaacggattgcgtctgggtgtgtccgagacagcacttgcgcttgacgccctgggggcgatggatgccttcacctctgatgattgccgccgcgcgctccgtcccatctgcaccggttgtaaagaagaagtggatcagttcgatgcgctcttcgacgcctactggcttgatgcaggtcgagtcaggacacgcgtgatgccgacgcatgtaccaagcgcgagcgatcatgtgcattcttcccgcgatgcagaaggcgaggcttcgggcggcacaggtacggcgacgatgccggacggtggtgatggcgagtccgaacgcgatggcgaaggcaagctcattgcgactgaggttcgcaacctgtcccgtcgcgatctccgcgatctggtgcggcctgaagagattgccgaggctgaggaagtcgcacgccgtctcggagctgccctccgcgaccgccgttcgcgacgacgcattgcggcccgcaagggtgatcggctgcatttccgcaagactatccggcgtagcctctcgacaggtggggaaccattgcacctcctgcgcaagaaacgtcccgaccggacccgcaagatcaccgcgatttgcgatgtgtcgggctccatgaccgtctacgcgcaggtgttccttgccttcatagcaggcctcatgcgcgccgatccgctggccgatgcctacctgttccacacccggcttgtgcggatcacagaaacgctccgcgacaaggacgccttgcgtgccatcggccgcatgtcccttatggcggacggtttcggcggaggctcgaagatcggcgaatgcctggatcgctttgcgcatacctatgccaggcgctttgtggacgggcgcagcgtcgtcctgatcctctcagacggctatgacacgggcaaaccggaagcgatgagtgtagcgcttggtcagttgcgcaaacgcggctgcaagatcatctggctgaatccgctcaagggctggcgcgactacgaacccgtaacagcgggcatggctgccgctttgccgcatctcgatctgttccgtgcggcgaataccctggacgatctcgcggcactggaaggggaactcacacggctatga

SEQ ID NO: 442 - protein, 393 aa, Unknown
  Obtained from environmental sample
  DOMAIN (147)...(383): VWA domain containing CoxE-like protein
  SITE (147)...(150): N-glycosylation site. Prosite id = PS00001
MSRVTRFAARDPGPAARLSGFVAHLRDNGLRLGVSETALALDALGAMDAFTSDDCRRALRPICTGCKEEVDQFDALFDAYWLDAGRVRTRVMPTHVPSASDHVHSSRDAEGEASGGTGTATMPDGGDGESERDGEGKLIATEVRNLSRRDLRDLVRPEEIAEAEEVARRLGAALRDRRSRRRIAARKGDRLHFRKTIRRSLSTGGEPLHLLRKKRPDRTRKITAICDVSGSMTVYAQVFLAFIAGLMRADPLADAYLFHTRLVRITETLRDKDALRAIGRMSLMADGFGGGSKIGECLDRFAHTYARRFVDGRSVVLILSDGYDTGKPEAMSVALGQLRKRGCKIIWLNPLKGWRDYEPVTAGMAAALPHLDLFRAANTLDDLAALEGELTRL

SEQ ID NO: 443 - DNA, 1272 bp, Unknown
  Obtained from environmental sample
atgccaagcaatcgaaccgacgtcgtcgtcctcggggccggcatcatcggcatctgcgtcgcgctgcaccttcagaagcgcgggcgtgcagtgacgctcctggatcggcgtggcgcagccgaggagacctcctacggaaacgccgggctgatccagcgcgaaggcgtctttccgtacggattcccgcacgacttcggcgcgctcctccgctacgggctgaatcgcacgatcgacgcgcactaccacgcgtccgcgctgccgcggctcgcgcccttcctgtggcagtactggcatcactcgcgccctgcgcggcatgccgaggtcgcgcgccgctacgcgaagctgatcgagcactgcgtggtggagcacgatgcgctcgcgcgcgaagcgggcgcagaagagttcatccggcgcgtgggctggatcaaggtgttccgcaccgcgcgggagcgcgaccggcgcttcgccgaggccgcgcgttggcatcgcgagttcgggctcaactaccgggcgatcgacgctcctgcgctgcaggagatggagccccatctcgcccccgcgctcgccggcgcgctgcactggaccgatccgaccagcgtcgacgatccgcaaggactggcacatgcctacctgcgtcacttcgagcgcctcggcggaaggttcgtgcagggcaacgccgcgagcctcgaggcgcagggcgcggggtggcgactgcgcaccgcgggaggcattctcgaggccggtgcggcggtgatcgcgctcggcccctgggcaggcgtgctgacgcgcgcgctcggctacgacctgccgctggcggtgaagcgcggctaccacatgcactaccgggccgcgggtgaagcgcgcctgaaccatccaaccctggatgccgagcgcggctactttctcgcgccaatgcgtcgcggcatccggctcaccacgggagcggagttcgcgctgcacgacgcaattcgaacgccggtgcagctcggtcgcgccgagccgatcgcgcgcgagctctttccgcttgccgagcgtctcgacaccgaggcctggatgggcgcgcgtccctgcacgccggacatgctgccggtgatcggcagggcgccgcgccacgcgagcctgtggttcgctttcggccatgcgcaccacggcctgacgctcggtccggtgaccggaaggctgatcgccgagctcgtcacgggcgaaacgccgttcgtcgatccggcgccgtattcggccgcgcgcttcgaaggcggcaaccgcgggcgttga

SEQ ID NO: 444 - protein, 423 aa, Unknown
  Obtained from environmental sample
  DOMAIN (7)...(398): FAD dependent oxidoreductase
  SITE (4)...(7): N-glycosylation site. Prosite id = PS00001
  SITE (75)...(78): N-glycosylation site. Prosite id = PS00001
MPSNRTDVVVLGAGIIGICVALHLQKRGRAVTLLDRRGAAEETSYGNAGLIQREGVFPYGFPHDFGALLRYGLNRTIDAHYHASALPRLAPFLWQYWHHSRPARHAEVARRYAKLIEHCVVEHDALAREAGAEEFIRRVGWIKVFRTARERDRRFAEAARWHREFGLNYRAIDAPALQEMEPHLAPALAGALHWTDPTSVDDPQGLAHAYLRHFERLGGRFVQGNAASLEAQGAGWRLRTAGGILEAGAAVIALGPWAGVLTRALGYDLPLAVKRGYHMHYRAAGEARLNHPTLDAERGYFLAPMRRGIRLTTGAEFALHDAIRTPVQLGRAEPIARELFPLAERLDTEAWMGARPCTPDMLPVIGRAPRHASLWFAFGHAHHGLTLGPVTGRLIAELVTGETPFVDPAPYSAARFEGGNRGR

SEQ ID NO: 445 - DNA, 1245 bp, Unknown
  Obtained from environmental sample
atgaagccaaccatcattgtaggaggagggataattggccttttcactgcatatttcctccaaaaagagggtattgaagtccagattattgacaaaggtgacatggaggtgaactgttccacaggtaatgccggaatgattgtacccagccatattattcctttggctgcaccggggatgatttccaaaggaatttcgtggatgttctcttccaaaagtccgttttatgttcacccaaggttagataggaaattaatcgaatggtcttggcttttttaccgttcggccaataaatcacatgtggaaaaatccattccctttctcaaaaatatcagtcttttaagtaaagccctttaccaacaatttaaggaagaacacaagggagcagatttccaaatggtagaaaagggattgatgatgctttaccaaacatcagaagtggaaaaagaggaagtagagtttgcacatttggccaatcaacatggcttgggtgcggaagtcctaaccccttctgatatccaaaaaatcgaacccaatcttgaggtaaaagccaaaggggcagttttgtttccaggggatgcccacttatctccagctgctttgtattcttttttgaaaaagtatttagaagagaaaggaattcaattccacagcaaagttaaagtaaccggtttccaaacccgctcaggaaaagtggaggcagtaatcactgaaaatggaagggtggagggagctcaatttattctttgcggaggggcttggtcagccgagttggctgccatgctcgggctgaaacttcctatgatgggaggcaaaggttacagctttattcaggagaataaaccggaaatcaaacaggcaagtattttgaccgagatgaaagtggctgtaagtccctatggcaagcaggtaaggtttggaggaaccatggaaattgccggaacggatgaaaaagtaaatatgaatcgtgtacgaggaatttttgaatccatcaacaggtattatccaagttttcaatcccaatttcccaaagaaggagaaatctggaaaggactaagaccctgttctccggatggcttgccatatattggtaaatctaaagtatggtcgaatgtgttgattggttccggccatgggatgatgggactgagtatggctcctgcaactggaaagatcctggcagacctccatgaagggcatgcttcaatgatggatttaaaggcttttgaggtggggaggttttaa

SEQ ID NO: 446 - protein, 414 aa, Unknown
  Obtained from environmental sample
  DOMAIN (3)...(396): FAD dependent oxidoreductase
  SITE (38)...(41): N-glycosylation site. Prosite id = PS00001
  SITE (98)...(101): N-glycosylation site. Prosite id = PS00001
  SITE (111)...(114): N-glycosylation site. Prosite id = PS00001
MKPTIIVGGGIIGLFTAYFLQKEGIEVQIIDKGDMEVNCSTGNAGMIVPSHIIPLAAPGMISKGISWMFSSKSPFYVHPRLDRKLIEWSWLFYRSANKSHVEKSIPFLKNISLLSKALYQQFKEEHKGADFQMVEKGLMMLYQTSEVEKEEVEFAHLANQHGLGAEVLTPSDIQKIEPNLEVKAKGAVLFPGDAHLSPAALYSFLKKYLEEKGIQFHSKVKVTGFQTRSGKVEAVITENGRVEGAQFILCGGAWSAELAAMLGLKLPMMGGKGYSFIQENKPEIKQASILTEMKVAVSPYGKQVRFGGTMEIAGTDEKVNMNRVRGIFESINRYYPSFQSQFPKEGEIWKGLRPCSPDGLPYIGKSKVWSNVLIGSGHGMMGLSMAPATGKILADLHEGHASMMDLKAFEVGRF

SEQ ID NO: 447 - DNA, 1308 bp, Unknown
  Obtained from environmental sample
atgcgtgttctgattctcggtagcggcgtgatcggcaccaccaccgcttggtatctgcgccaggccgggtgtgaggtgaccgtggtcgaccgtcaacccgggccggggctggaaaccagcttcgccaatgccggccagctctcgttcggctacacctcgccctgggcggcgccgggggtgccgaagaaggccatcggttggctgttcgagcagcacgcgccactggcgatccgtcccggcatggacctggcccagtacgcgtggctgtggcagatgctgcgcaactgcacccacgatcgctatgcgatcaacaaggcgcgcatggtgcgtctctcggaatacagccgcgactgcctgaaccagctgcgcgcggagaccggcatcgactacgaaggccgcgagctgggcacgacccagctgttccgcacccagcagcagctggatgcgtcggcgcaggacatcgaggtgctggcgcaatacggcgtgccctatgaagtcctggaccgcgacggcatcgtgcgtgccgaaccggcgctggcgcacgtggcccataccctggtgggcgcgttgcggctgccacgcgaccagaccggcgactgccagctgttcacccgccggctggcggcgatggcggccgaggtcggcgtcgagttccgctacgaacaggacatcacctcgttgcagcgcgacggcgaccgcatcaccggtgtgcgcatcggcggccggctggaaaccgcggaccactacgtggtggcgctgggcagttactcgccggcgctggtggcaccgctggggctgcgcctgccggtgtacccgctgaagggctattcgctgaccctgcccatcgtcgacccggccatggcgccgacctcgaccatcctggacgagagcttcaaggtggcggtcacccgcttcgacagccgcatccgcgtgggtggcatggccgaagtggccggtttcgacctgtcgctgtcgccgcgccgccgcgccaccctggagcgcgtggtctgcgacctctacccgaagggcggcgacctggggcgcgccgaattctggaccggtctgcgcccggccacgccggacggcacccccgtggtaggcgccaccccgctgcgcaacctgttcctcaacaccgggcacggcacgctgggctggaccatggcctgcgggtcgggccgctatctggccgacgtgatgtgcgcgcgccagccgcagatcagcagcgaaggcctggatatcttccgctatggccaccgccgccccgccgccccgatggagagccgcgcatgcgcccagcccgcgcgctga

SEQ ID NO: 448 - protein, 435 aa, Unknown
  Obtained from environmental sample
  DOMAIN (2)...(398): FAD dependent oxidoreductase
  SITE (96)...(99): N-glycosylation site. Prosite id = PS00001
MRVLILGSGVIGTTTAWYLRQAGCEVTVVDRQPGPGLETSFANAGQLSFGYTSPWAAPGVPKKAIGWLFEQHAPLAIRPGMDLAQYAWLWQMLRNCTHDRYAINKARMVRLSEYSRDCLNQLRAETGIDYEGRELGTTQLFRTQQQLDASAQDIEVLAQYGVPYEVLDRDGIVRAEPALAHVAHTLVGALRLPRDQTGDCQLFTRRLAAMAAEVGVEFRYEQDITSLQRDGDRITGVRIGGRLETADHYVVALGSYSPALVAPLGLRLPVYPLKGYSLTLPIVDPAMAPTSTILDESFKVAVTRFDSRIRVGGMAEVAGFDLSLSPRRRATLERVVCDLYPKGGDLGRAEFWTGLRPATPDGTPVVGATPLRNLFLNTGHGTLGWTMACGSGRYLADVMCARQPQISSEGLDIFRYGHRRPAAPMESRACAQPAR

SEQ ID NO: 449 - DNA, 1248 bp, Unknown
  Obtained from environmental sample
atgaagcgtgatgtgatcgttctcggcgccggcatggtcggcgtgggctgtgcgctgcacctgcaggccaggggcctgtcggtcgcgttgctggaccgccgcgcgcccgggcttgaaacctcgtacggcaacgccggcatcatccagcgcgaagccatcgggccttatgcgctggaccgcgacctgggctttctgctctcgggcatgaccaaccggcgcgtcgacgtgcgttaccacctcggcgatgccgcccggctgctcgggccgctgtggtcctactaccagaactcggcgcccgacgcgtaccagaagatcgccgccgagtacgagaccctcatcgcgcactcgctcgacacgcacgggcaactgatgcgcgacgcccatgccgaacacctggtgggcgggcatggttacctcgcgctctaccgctccgagcgcgacctgcacgagctcttcaaggtggccgacgagcgcgcgctcaagggcgtgcaccacgtcaagctcagcggcgccgacgtggcgcaggccgagccctcgctcgtgggcgacttcgccggcgcggtgcgctggaccgacccgctggccatcagcagcccgggggatctggtgcaggcctacgcgcggctgttcgcgcaacggcgcggcacgctgcacgtgggcgatgcgatggcgctgcgccgcaccgatgcgggccattggcaggtggacgcggccgacgacgtgctcgaagcgccccgcgtggtggtggcgctcgggccgtggaccaccgagctgaccgcgcgctatggctacaccgcgcccgtgattcccaagcgcggctaccacgtgcactacatgcgggtgccgctccagccgctcaacagcaccgtgatcgatggcgaccacggcttcgtggtcgcgcccatgaaggacggcctgcgcctgaccaccggcgccgaactcgcgatgcccgacgccccgcgcacgccgacgcagatcgaggcggccgagaagatcgcccggctcgtctacccgctcggtgagcgcgtggagcccgagccctggatgggcacgcgcccctgcatgcccgacatgaaaccggtgttcggcgcggtgcccgacgtgcccggcatgtggtgcgccttcgggcatgggcaccaggggttcacgctcgggcccatcaccggcgagttgctcgccgccatggtgacgggcgcaccaccgcgggtggacgtgcggccgttttcgccggagcggttcgggcggtag

SEQ ID NO: 450 - protein, 415 aa, Unknown
  Obtained from environmental sample
  SIGNAL (1)...(23)
  DOMAIN (4)...(395): FAD dependent oxidoreductase
  SITE (291)...(294): N-glycosylation site. Prosite id = PS00001
MKRDVIVLGAGMVGVGCALHLQARGLSVALLDRRAPGLETSYGNAGIIQREAIGPYALDRDLGFLLSGMTNRRVDVRYHLGDAARLLGPLWSYYQNSAPDAYQKIAAEYETLIAHSLDTHGQLMRDAHAEHLVGGHGYLALYRSERDLHELFKVADERALKGVHHVKLSGADVAQAEPSLVGDFAGAVRWTDPLAISSPGDLVQAYARLFAQRRGTLHVGDAMALRRTDAGHWQVDAADDVLEAPRVVVALGPWTTELTARYGYTAPVIPKRGYHVHYMRVPLQPLNSTVIDGDHGFVVAPMKDGLRLTTGAELAMPDAPRTPTQIEAAEKIARLVYPLGERVEPEPWMGTRPCMPDMKPVFGAVPDVPGMWCAFGHGHQGFTLGPITGELLAAMVTGAPPRVDVRPFSPERFGR

SEQ ID NO: 451 - DNA, 1245 bp, Unknown
  Obtained from environmental sample
atgaagccggacatcgtggttctcggcgccggcatggtcggcgtctgcgtcgcgctgcacctgcagaagcgcgggcgcggcgtggtgctgatcgatcggcgcggcgtggccgaggagacttcgttcggcaatgccggcatcatccagcgtgaggcggtctccccgcatccctttccgcaggacctcgccacgctcctgcgctacggctcgaaccgttccatcgatgcctgctaccaccttgcagcgctgccgtacatcgcgtctttcctttggcagtggcggcgccactcgcaggcggagcggcatgccgagatcacgcggcattacgcgcgcctgatcgaacattgcaccgccgagcacgatgcgcttgccgcggcggcaggcgcggccgatctgctgcgtcgggacggatggatccgcgtgtaccgttccacggagaaattcgccgcaggcctggccgacgccgagcacctccagcgcacgtacggtgtcgcgtttcgtgcgttggatccacaggccctgaagcaagctgagccgcatctcgcgccggtgctctccggcggcttgcattggacgcagccgatcaccgtgggcaacccgcaggccctcgcagcggcctacctgcggcacttcgaaacgctcggcggacgcttcgtgcaaggcgacgcagcgacactgcgcgcggtcggcacgggttgggggatcagcactgcgcagggaccgattgaggcgtccgacgcggtcattgcgctcggaccctgggccgacgtcgtcacgcgcaagctgggctacaacctgccgctcgcagtgaagcgcggatatcacatgcactatcgcaccgcggacggcgcaaggctcaaccatcccgtggtcgacagcgaaacagggtactgcctcgcgcccatggcgcgcggcatccgtctgacgacgggcgccgagttcgcgcggcgcgacgccattcgcacacccgtgcagctcgctcgtgccgaaccgatcgcgcgcaagctgttcccgctcgccgaacgagtggacgacgagccctggatgggcgcgcgtccctgcacgccggacatgctgccgatcatcggccgggccacgcgccaccgcaatctctggttcacgttcggccacgcgcaccaggggttcacgctgggtgccgtgaccgggcggttgatcgccgagatgctcactggagaggagcccctggtggacccggcgccatatcggccggatcgattctcctga

SEQ ID NO: 452 - protein, 414 aa, Unknown
  Obtained from environmental sample
  DOMAIN (4)...(395): FAD dependent oxidoreductase
  SITE (72)...(75): N-glycosylation site. Prosite id = PS00001
MKPDIVVLGAGMVGVCVALHLQKRGRGVVLIDRRGVAEETSFGNAGIIQREAVSPHPFPQDLATLLRYGSNRSIDACYHLAALPYIASFLWQWRRHSQAERHAEITRHYARLIEHCTAEHDALAAAAGAADLLRRDGWIRVYRSTEKFAAGLADAEHLQRTYGVAFRALDPQALKQAEPHLAPVLSGGLHWTQPITVGNPQALAAAYLRHFETLGGRFVQGDAATLRAVGTGWGISTAQGPIEASDAVIALGPWADVVTRKLGYNLPLAVKRGYHMHYRTADGARLNHPVVDSETGYCLAPMARGIRLTTGAEFARRDAIRTPVQLARAEPIARKLFPLAERVDDEPWMGARPCTPDMLPIIGRATRHRNLWFTFGHAHQGFTLGAVTGRLIAEMLTGEEPLVDPAPYRPDRFS

SEQ ID NO: 453 - DNA, 1254 bp, Unknown
  Obtained from environmental sample
atggacgacgtcatcatcctgggcgcggggatcgtgggaatcgcgacggggattcacctgttgcggcgcgggcgcagcgtgacgctggtggaccgcaatgcgccgggccgcgaaaccagtttcggcaatgccgggatcatccagcgcgaaggcgtgcgcccgcatgcctttccgcgcgacctgcagacgctgctgcaggtggggctgcacctgtccaccgcagcgcgctattcgccgctggcgctgccgaagctggcgccgccgctgctgaaatattggtgggaatcctcgcccgagcattatcgcaaagtggtgcaatcctatgcgccgctgatcgggcgctccatcctcacccataacgacttcatcatggcggtggggccggacgcggagaagctgatttcgcgctatggctggcacctggccttccgcagccaggacaagttcgagcgggaaatcgccaaggccgagggcgaccacgcgcaattcggcatcggctatcgcgcgctggactggcccgcgttaaaggccgccgagccaaacctgatcggcgggctggtgggggccatccactggaccgatccctggacggtacgcgacccgggcgctttggtatccgcctatttcgggctgttcgaaaagctgggcggcacgttcgtcagcggcgcggccagcgggttggtgccggaggcggatggctggagcagcatggtcgatgggcagaagctgatggcccggcaggcggtgatcgcgctcgggccctgggcgccggacgtgctggagccgctgggctatcgcctgccgcttttcgtcaagcgcggctatcacatgcattatagcgcgcaggagggcgctgaactcaagcacctgctgctcgacccggaagtgggctatgccatggcgccgatggcagcgggcatccgcatcaccaccggcgccgaattttcgctgcgcgatgccaagccgaccccgatccagctcgccaaggcggagaaggcggcgcgcgagctgttcccgctgggtgaacggcgcgacccgcagccctggaagggcgcccgcccctgcacgcccgacatgatgccgatcatttccaaagcgccccggcacgaggggctttatgtggggatcggccacgcccatcacggctttacgctgggcccggcgacgggcgaattgctggcgcagacgatgacgggggaagagacggccatcgatatcaaaccgttccggatggagcggtttctgggagggtga

SEQ ID NO: 454 - protein, 417 aa, Unknown
  Obtained from environmental sample
  DOMAIN (3)...(396): FAD dependent oxidoreductase
MDDVIILGAGIVGIATGIHLLRRGRSVTLVDRNAPGRETSFGNAGIIQREGVRPHAFPRDLQTLLQVGLHLSTAARYSPLALPKLAPPLLKYWWESSPEHYRKVVQSYAPLIGRSILTHNDFIMAVGPDAEKLISRYGWHLAFRSQDKFEREIAKAEGDHAQFGIGYRALDWPALKAAEPNLIGGLVGAIHWTDPWTVRDPGALVSAYFGLFEKLGGTFVSGAASGLVPEADGWSSMVDGQKLMARQAVIALGPWAPDVLEPLGYRLPLFVKRGYHMHYSAQEGAELKHLLLDPEVGYAMAPMAAGIRITTGAEFSLRDAKPTPIQLAKAEKAARELFPLGERRDPQPWKGARPCTPDMMPIISKAPRHEGLYVGIGHAHHGFTLGPATGELLAQTMTGEETAIDIKPFRMERFLGG

SEQ ID NO: 455 - DNA, 1242 bp, Unknown
  Obtained from environmental sample
atgaaagtaacaatagtaggagctggagtggttggattatgctgcgcttattacctggacaaagaaggtttcgacatcaccgtcattgatcgtaatgatataaccgatggatgttcgtttggaaacatgggttatatttcccccagccattttataccgctggcatcaccaggaattgtcagccagggtttgaagtggatgctgagttcatcttctcctttttatataaaaccgagattgaattgggaactgatgcaatgggggatgaccttctggaaaaactccaatgcgcaaaaagtgaaagccagtattccccatctcaataacttattgctgttaagccgtgatttaatgaatgacctgaagaaggaattcaatgattcttttagcatgatcgagagaggatgctggacgctttacaaaaatgaaaagaccggtgatcatgaaaaacacttaacggaacaggcaacaggcttgggtttgaaaacccaaacttataccgggacccaagtacaggaaatggaaagtgaagtggaagtaaatgtggccggtggtgtattgtggctcgacgattgtcatttggactctgcaaaactgatgcggtcgttgcaccgttatttgcaggaaaagggtgtaaagtttcttctcaataccgaagtaaaaggctttgaaaggaccaacggaaaaataaattcggtgatcaccgataaagaaaaaataaatgctgatgaagtaattgttgccaatggttcatggatgcctgccgttgcgaggatggccggaattcacttgttgatgcaacccggcaaaggatatagcgtggtgtatgagaatatggaaaagaaccttcgtcggcccgcaatattggtagaagcacgcacggcgatgacgccgattgaacgctggctcaggataggagggacgatggaattaagtggacacagtgataatatcttgccgaagcgggtcaatgccatttacgaatccgtaaacaaatattttccttcattaaatatttcgcagcccgatccggcaaaggcatggtatggctacaggcctgtgacacctgatggcctgccctatattggaaagcataaaaaattcgcgaatctcacgttcgcgggtggtcatgcgatgctgggcgtatccgcagcggctgctaccggaaaattggtcaatgagatcatcggaaatcgacctacgtcgattgacatttttgcctttgagccggagagattttga

SEQ ID NO: 456 - protein, 413 aa, Unknown
  Obtained from environmental sample
  DOMAIN (2)...(395): FAD dependent oxidoreductase
  SITE (127)...(130): N-glycosylation site. Prosite id = PS00001
  SITE (252)...(255): N-glycosylation site. Prosite id = PS00001
  SITE (343)...(346): N-glycosylation site. Prosite id = PS00001
  SITE (375)...(378): N-glycosylation site. Prosite id = PS00001
MKVTIVGAGVVGLCCAYYLDKEGFDITVIDRNDITDGCSFGNMGYISPSHFIPLASPGIVSQGLKWMLSSSSPFYIKPRLNWELMQWGMTFWKNSNAQKVKASIPHLNNLLLLSRDLMNDLKKEFNDSFSMIERGCWTLYKNEKTGDHEKHLTEQATGLGLKTQTYTGTQVQEMESEVEVNVAGGVLWLDDCHLDSAKLMRSLHRYLQEKGVKFLLNTEVKGFERTNGKINSVITDKEKINADEVIVANGSWMPAVARMAGIHLLMQPGKGYSVVYENMEKNLRRPAILVEARTAMTPIERWLRIGGTMELSGHSDNILPKRVNAIYESVNKYFPSLNISQPDPAKAWYGYRPVTPDGLPYIGKHKKFANLTFAGGHAMLGVSAAAATGKLVNEIIGNRPTSIDIFAFEPERF

SEQ ID NO: 457 - DNA, 1251 bp, Unknown
  Obtained from environmental sample
atgggaaaaaacgttttgatcattggcggaggaatagtgggactctgctctgcatattttttacataaagaagggcatcaggtaaccgttttggataagtcggatattacttccggtgcctcttttgtcaacgctggatttattaccccaagccatattattccactggcctctccgggaatgattttaaaaggaattaaatggatgtttagtccaaccagtccgttttatatgcaacccagatgggatatcgacttttttaaatggtcctggtattttcataaatcttccacaaaggaaaaggttgcactggccattccgttaattaaagaaagtaacctaataagtagggaactttttacagccattaaaaattctggggatttagggaattttcagctggaacgaaagggcttattaatgttatataaaactgaggcagaaggggaacatgaaatgcaagtggcggaaaaagcttcctttttaggcctagaagtaagttacttggataagaatactttggataaattgcagccccaagtgagcatggatgttagaggggctattcattatgagtgtgatggacataccacaccaacagaattcatggagaaaatgctggattacctaagacgaagcggcgtaatcatcaagaccaaagaagaggttaaggatttattgataaataacaatcaaataaccaaggtaatcacagacaagtctgattattcagccgatgaaattgttttggcggcaggatcttggagcgagaaattatccaaaaaaatgaggctaaaactccccatacaggcgggcaagggatacagtataaacgtaccgcgcccaacagggattaccattcctgccattttaatggaagctaaggtagccgtgactcctatgaaggagtatacccgatttgcaggaacaatggagttttctggaataaacgaaatcattaaaaaacagcgagtggaggctatagccaaagcagtcactgaattttatccggacatcgaaattaacgacatggaaatagcgggtgcaaaaagtgggcttcgcccagtttctcctgatggcttaccatacattggcaaatgctcctccttaaaaaatttaaccattgccacaggacatgccatgatgggctggagtcttggaccggttacaggacaattggtctcggaaataatatcgaacaaaaaacctgttatggatattgctggcttttccccaaatagaaaattctag

SEQ ID NO: 458 - protein, 416 aa, Unknown
  Obtained from environmental sample
  DOMAIN (4)...(397): FAD dependent oxidoreductase
  SITE (377)...(380): N-glycosylation site. Prosite id = PS00001
MGKNVLIIGGGIVGLCSAYFLHKEGHQVTVLDKSDITSGASFVNAGFITPSHIIPLASPGMILKGIKWMFSPTSPFYMQPRWDIDFFKWSWYFHKSSTKEKVALAIPLIKESNLISRELFTAIKNSGDLGNFQLERKGLLMLYKTEAEGEHEMQVAEKASFLGLEVSYLDKNTLDKLQPQVSMDVRGAIHYECDGHTTPTEFMEKMLDYLRRSGVIIKTKEEVKDLLINNNQITKVITDKSDYSADEIVLAAGSWSEKLSKKMRLKLPIQAGKGYSINVPRPTGITIPAILMEAKVAVTPMKEYTRFAGTMEFSGINEIIKKQRVEAIAKAVTEFYPDIEINDMEIAGAKSGLRPVSPDGLPYIGKCSSLKNLTIATGHAMMGWSLGPVTGQLVSEIISNKKPVMDIAGFSPNRKF

SEQ ID NO: 459 - DNA, 1266 bp, Unknown
  Obtained from environmental sample
atgcaacgcattgccgttatcggtggcggtatcaccggcattaccagcgcctacgccctagccaaacgtggctatcaggtcaccgtctttgaaaaacatcgttacgccgccatggagacctcgttcgccaacggtggtcagctttcggcttcgaatgccgaagtgtggaaccactggccaaccgtaattaagggcatgcgctggatgctccgaaacgatgccccgctgctggtcaaccctcgccccagctggcacaagctcagttggtttggcgaatttatcgcctcgattccccgctactctgagaacactaccgagaccgcgcggctggcgattgcggcacgcgagcatctgtttcagtgggcgcaggaagagcaaatcgattttgatttaaagcagaaaggcattctgcatatttaccgcgataaagcgggctatgaccacgccgccaaggtctcacaactgctcagcaaaggcggcctggagcgtcgcgcggtaacccctgacgagatgcgcactatcgagccgacgctggcgggcaactactatggtggcttctttaccgaaagcgatgccacgggtgatattcataagtttacccacggcctggctcaagccgccgagcgccgtggtgtaacgcttaaatatggccacagcgtgcaggatctcggcgcggacgaacagcacgcatgggtcaccgccaccattgaaggcgaggccgacggtgaaccggtgcgtgaaacattcgatagcgtggtggtctgcgccggggtgggcagccgtgccctggctgccaagctgggagaccgggtcaatatctacccggtcaaaggctactccattaccgtgcagcttgacgatgccgcctcccagcaggccgcccccaccgtaagcctactcgatgatgaaaccaaactggtgaccagccgcctgggcgatgaccgctttcgtattgccggtaccgccgagttcaacggtttcaatcgcgacattcgcgacaaccgcatccgcccattgatccgctgggtggaagagtgcttccccggcgtcagcacccgccgcgtagtgccctgggcaggcctacgcccgatgcttcccaacatgctgcctaaggtcggccccggcaaattacccaccgtgttctacaacaccggccacggccacctgggctggacgctctctgcgattaccgccgatatgctggcggatgcggtgcaagcggcggaagaagcatcggcaccagcgagagcatcacactcagtgtga

SEQ ID NO: 460 - protein, 421 aa, Unknown
  Obtained from environmental sample
  SIGNAL (1)...(21)
  DOMAIN (3)...(404): FAD dependent oxidoreductase
  SITE (104)...(107): N-glycosylation site. Prosite id = PS00001
MQRIAVIGGGITGITSAYALAKRGYQVTVFEKHRYAAMETSFANGGQLSASNAEVWNHWPTVIKGMRWMLRNDAPLLVNPRPSWHKLSWFGEFIASIPRYSENTTETARLAIAAREHLFQWAQEEQIDFDLKQKGILHIYRDKAGYDHAAKVSQLLSKGGLERRAVTPDEMRTIEPTLAGNYYGGFFTESDATGDIHKFTHGLAQAAERRGVTLKYGHSVQDLGADEQHAWVTATIEGEADGEPVRETFDSVVVCAGVGSRALAAKLGDRVNIYPVKGYSITVQLDDAASQQAAPTVSLLDDETKLVTSRLGDDRFRIAGTAEFNGFNRDIRDNRIRPLIRWVEECFPGVSTRRVVPWAGLRPMLPNMLPKVGPGKLPTVFYNTGHGHLGWTLSAITADMLADAVQAAEEASAPARASHSV

SEQ ID NO: 461 - DNA, 762 bp, Unknown
  Obtained from environmental sample
atgcctagcgtacttatcacaggagctacttcagggtttggtaaagcggcagcacagcgcttcgccaaagcaggctggtcgttgatcctcaccggtcgccgccaggaacgcttagatgcactggaaaaagagctaagccagcaggttccagtacttacactggcactggatgtccgcgacagcgacgctgtgactgacactattagcaacctgccggaaagctttctgccgctgacgtgcctgattaacaatgcagggttagcgttagcgccggagccagcgcaaaaagtcgcgctgcaggattggcacaccatgatcgataccaacatcaccgggttggtcaacgtcacccacgcggcattgccgctactgctcaaaaacagcgaaggtgcgagcattcttaatttaggctcagtcgcaggccagtggccgtatccgggcgggcatgtgtatggggcgtcaaaagcgtttgttcagcagtttagttataacctgcgctgcgacctgctaggaacaggtgtccgcgtgaccgatcttgcccccggcatggcagaaaccgagtttacgctggtaagaaccaagggcaatcaggccgcgtcagacgcactttataaaggaacaacgccacttcaagcggaagatattgccgagcagcttttctacctagcgacactgcccgcccatatcaatattaatcggttggaaatcatgccggtgcggcaagcgtggtcagcatttgccattgaccgcgacccggcttaa

SEQ ID NO: 462 - protein, 253 aa, Unknown
  Obtained from environmental sample
  DOMAIN (2)...(170): short chain dehydrogenase
  DOMAIN (2)...(182): KR domain
  DOMAIN (4)...(232): NAD dependent epimerase/dehydratase family
  SITE (110)...(113): N-glycosylation site. Prosite id = PS00001
  SITE (116)...(119): N-glycosylation site. Prosite id = PS00001
  SITE (140)...(168): Short-chain dehydrogenases/reductases family signature. Prosite id = PS00061
MPSVLITGATSGFGKAAAQRFAKAGWSLILTGRRQERLDALEKELSQQVPVLTLALDVRDSDAVTDTISNLPESFLPLTCLINNAGLALAPEPAQKVALQDWHTMIDTNITGLVNVTHAALPLLLKNSEGASILNLGSVAGQWPYPGGHVYGASKAFVQQFSYNLRCDLLGTGVRVTDLAPGMAETEFTLVRTKGNQAASDALYKGTTPLQAEDIAEQLFYLATLPAHININRLEIMPVRQAWSAFAIDRDPA

SEQ ID NO: 463 - DNA, 1248 bp, Unknown
  Obtained from environmental sample
atgggtaaaaatattgttattgttggcggtggaattattggattgaacgcagcctattatttgcagaaagagggacataaagtaactgtaattgataaaagtgatatttcttcaggagcatcttttgtaaatgcaggatatattacgccaagtcatattatccctttggcggctccgggaatgatatctaaagggattaaatggatgtttaattcttctagccctttttacataaaacctcgattagatattgattttttaaaatggtcttgggcttttaaaaaatcgtccacagctgccaaggtagaaaaagccatcccagttattaaagatataaatctattgagtagaggtttatacgaagacatgaaagtatcaggtgattttgattttcaatatgaacgtaagggcttactcatgtgctataagactgaaaagggtggtgaagaagaatgggaagtaggaaaacgtgctatcaaagaggggttgaatgtccaaaatttaacagctcaagaagttcataaactggaacccaatgccaaattaaatattaaaggagctgtttattttgattcggatgcccatatgacacctggcgagttcatgaatgagatggtacgttatttaaaggtaaagaaggttacatttttaaccaacgaggaagtaatagatatggtattgtctaatgataaaatatcagaggtcataacagataaaagaaatttgaaggtcgatgaagtagtaattgcagccggtagctggagtccgttggttactaaaaaattgggattgaagattcttatacaggcagggaaaggataccggattaatgtcaaacgtcagacaggcattactattccggcaattttagtagaagctaaagttgcagtaacccctatgaacagctttacgcgttttgccggaactatggaaatagccggtataaaccataaaataaatcctgtacgtgtgaagactatagctagagctgcggaatcttattatgagggattaaaaatagaacagctggaagtagataatgctgcatgtgggttaaggccttgttctcctgacggattaccttatataggtagagccagtaagtataaaaatttaactatagcaaccggacacgctatgatgggttggagtatggcaacagccaccggtaaattgatttcagaaattatttcagatcagaaattatctgtgaatattgatatgtttgatcctgaaaggaaattttaa

SEQ ID NO: 464 - protein, 415 aa, Unknown
  Obtained from environmental sample
  DOMAIN (4)...(396): FAD dependent oxidoreductase
  SITE (72)...(75): N-glycosylation site. Prosite id = PS00001
  SITE (169)...(172): N-glycosylation site. Prosite id = PS00001
  SITE (376)...(379): N-glycosylation site. Prosite id = PS00001
MGKNIVIVGGGIIGLNAAYYLQKEGHKVTVIDKSDISSGASFVNAGYITPSHIIPLAAPGMISKGIKWMFNSSSPFYIKPRLDIDFLKWSWAFKKSSTAAKVEKAIPVIKDINLLSRGLYEDMKVSGDFDFQYERKGLLMCYKTEKGGEEEWEVGKRAIKEGLNVQNLTAQEVHKLEPNAKLNIKGAVYFDSDAHMTPGEFMNEMVRYLKVKKVTFLTNEEVIDMVLSNDKISEVITDKRNLKVDEVVIAAGSWSPLVTKKLGLKILIQAGKGYRINVKRQTGITIPAILVEAKVAVTPMNSFTRFAGTMEIAGINHKINPVRVKTIARAAESYYEGLKIEQLEVDNAACGLRPCSPDGLPYIGRASKYKNLTIATGHAMMGWSMATATGKLISEIISDQKLSVNIDMFDPERKF

SEQ ID NO: 465 - DNA, 444 bp, Unknown
  Obtained from environmental sample
atgaccgctcgccgctggaccgtcctgaccgaacctttgcaaccacccttcgatgtcacgcggggcgtggagctgccgatcctggagcgtgttggcgcggatctggtggtggcggattcggcggaggcatggcgggaggccgcgccggatgccgacgccgtgctgcactggcgcatgccgattggcccggatgagatcgcgcggctcgaacgctgccgagtgatcgtgcactatggcgtcggcgttgaccgcatcgatttcaccggagccgctgccgccgggatttatgtggccaatgtcccccgctatggcacctccgaggtggcggaccacgccatggcgctgctgctggcgtcggtgcgcaaggtgcgacgcctcgatctggcgctgcgccaggggggatggggcgtgcacgcggtgcggccggtgccgcgcatctcgggg

SEQ ID NO: 466 - protein, 148 aa, Unknown
  Obtained from environmental sample
  DOMAIN (19)...(131): D-isomer specific 2-hydroxyacid dehydrogenase, catalytic domain
MTARRWTVLTEPLQPPFDVTRGVELPILERVGADLVVADSAEAWREAAPDADAVLHWRMPIGPDEIARLERCRVIVHYGVGVDRIDFTGAAAAGIYVANVPRYGTSEVADHAMALLLASVRKVRRLDLALRQGGWGVHAVRPVPRISG

SEQ ID NO: 467 - DNA, 1242 bp, Unknown
  Obtained from environmental sample
atggcacacgacattgtggtgctgggggccggcatgatcggcacctgcaccgcactcgaactgacgctgcgcggccatgccgtgacgcttgtcgaccggcagccgcccggacgcgagacgtcctatggcaatgcgggcgtcatccagcgcgaagcggtcgagccctatgcctttccgcgcgatgtgcgcaccatccttgccgcagccttcggtcgcgggctggacatccactatcaggcggcgggcctgttcggcgccttgccgcaattgatgcgctactggtggcattcggcgccgtcgcgacaccgacgcatcggaaaggcatatgccggcctgattgcccatgtcaccgaagagcacgggcgctacatggcgcttgcgggtgcgcaggatcttgtgcgacgcgaaggcctgcgcctgatgtaccgcagcgggcacgcgatggaagccgcggccgcgcacgcgcagcagctgcaccgcgaccatgggatcggcctggctctgctcgatgcgcgcgcccttgctgcggccgagcctgcctttcgcatccccatggcaggtgcggtccactggctggattcgtggagcgtcagtgatcccggcgcgctggtcgaacggtacgagtgcgcgtttcggcagcgtggtggccgattcgccagaggagacgcgaacagcttgcgtgagcgcgctggcggctgggaggtgcgtcttgacgaaggcgtcgtgcaggcgcgctatgccgtcgtggcattgggcccctggtccgatgtgctgacgcggcgcatgggctatcggctgccgctgttcatcaagcggggctaccaccggcattacgcaggcggcgacggtgtcaacgttccgacgctggacgcggagcggggctatgtgatgtcttcgcagcaacgcggcctgcgcatcaccaccggtgcggagattgcacgcatggatgctccctccacgccacgccagctcgccggcgcggaggccgaggtgcgcaagctgctgaacctcgggctgccggtcgaggcgcagccgtggctcggaagccggccttgctgtgccgacatgaaaccggtcatcggtcgcgcgcagcgccacaagggcctgtggttcaacttcgggcacggccaccacggcttcacgttggggccggccagtgcgcggctcctggcagacctgatcgaaggtggcacgccttacgcggaggcgacggcgttttcgccctcgaggtttccatgctag

SEQ ID NO: 468 - protein, 413 aa, Unknown
  Obtained from environmental sample
  DOMAIN (4)...(393): FAD dependent oxidoreductase
MAHDIVVLGAGMIGTCTALELTLRGHAVTLVDRQPPGRETSYGNAGVIQREAVEPYAFPRDVRTILAAAFGRGLDIHYQAAGLFGALPQLMRYWWHSAPSRHRRIGKAYAGLIAHVTEEHGRYMALAGAQDLVRREGLRLMYRSGHAMEAAAAHAQQLHRDHGIGLALLDARALAAAEPAFRIPMAGAVHWLDSWSVSDPGALVERYECAFRQRGGRFARGDANSLRERAGGWEVRLDEGVVQARYAVVALGPWSDVLTRRMGYRLPLFIKRGYHRHYAGGDGVNVPTLDAERGYVMSSQQRGLRITTGAEIARMDAPSTPRQLAGAEAEVRKLLNLGLPVEAQPWLGSRPCCADMKPVIGRAQRHKGLWFNFGHGHHGFTLGPASARLLADLIEGGTPYAEATAFSPSRFPC

SEQ ID NO: 469 - DNA, 1245 bp, Unknown
  Obtained from environmental sample
atgacagcggatgcgattgtccttggtgcgggcataattggggtttccacagcactgcaactggcccgtcgcggcaagtccgtcgtccttgtcgaccgccgcggcccgggtgaggaaacatcctacggcaatgccggcctcatccagcgcgaaggtgtcgttccctacggctttccgcagcagttcggccagatcctgcgctacgcactgaacaaccagatcgatgcccattttcactggcgcgccatcccaaccgtcagctcctttctcgcgaaatactggtggcattcgaatctcagccggcaccagctgatcgcaagggcctatgcgccgcttatcgagcattcgatcgacacccatgacgagttgatcagagaggccggcgcggagcacctcattgccaaggacggctggacggaactcttccgtaccccctcgaaacgggaccgggaactgaaggaggcggcacgcctcgccaaggaatacggcgtcagcttcaaggaattggcgcccgcggaacttgcagcgcaggagccgcatctgagcacggaattcgtcggcggactgaaatgggaagacccctggtccgttctcgatcctcacgcgctgaccatggcctatgtccgcctgttcgagaaactgggcggacgcgtgctgaagggcgacgccaggagcctgtcgcagacggcgaccggctggcgcgtggtggccggcgacggcaccgtcgaagccaaggatgcggtcgtggcgctcggcccctggtcggacaccgtgacgcggccgctcggctatcgcttcctggtcggcgtcaagcgcggctaccacatgcattacggcgcgaagggcaatgcgaagctcaacggctggaccatggatgccgagcggggctattttctcgcgccgatgacgcaaggcatccggctgaccaccggggccgagttcgcgttgcgcgatgcgccgaagacacccgttcagctccagcgcgccgagaccgtggcgcggacgatcttcccgctcggcgagcggctggacgaggagccctggatgggcgcccgcccctgcacgcccgacatgatgccggtgatcggcgaagcgccgcggcacaaggggctgtggttcgccttcggacatgcccatcacggcctgaccctcgggccgattacgggccaggtcatcgccgaggcgattgccggggaaaagacgcgcatcgacatttccgcctaccgcccggatcgcttcgcctga

SEQ ID NO: 470 - protein, 414 aa, Unknown
  Obtained from environmental sample
  DOMAIN (4)...(395): FAD dependent oxidoreductase
  SITE (99)...(102): N-glycosylation site. Prosite id = PS00001
MTADAIVLGAGIIGVSTALQLARRGKSVVLVDRRGPGEETSYGNAGLIQREGVVPYGFPQQFGQILRYALNNQIDAHFHWRAIPTVSSFLAKYWWHSNLSRHQLIARAYAPLIEHSIDTHDELIREAGAEHLIAKDGWTELFRTPSKRDRELKEAARLAKEYGVSFKELAPAELAAQEPHLSTEFVGGLKWEDPWSVLDPHALTMAYVRLFEKLGGRVLKGDARSLSQTATGWRVVAGDGTVEAKDAVVALGPWSDTVTRPLGYRFLVGVKRGYHMHYGAKGNAKLNGWTMDAERGYFLAPMTQGIRLTTGAEFALRDAPKTPVQLQRAETVARTIFPLGERLDEEPWMGARPCTPDMMPVIGEAPRHKGLWFAFGHAHHGLTLGPITGQVIAEAIAGEKTRIDISAYRPDRFA

SEQ ID NO: 471 - DNA, 1299 bp, Unknown
  Obtained from environmental sample
atgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaa

SEQ ID NO: 472 - protein, 432 aa, Unknown
  Obtained from environmental sample
  DOMAIN (2)...(397): FAD dependent oxidoreductase
  SITE (151)...(154): N-glycosylation site. Prosite id = PS00001
MRVVILGSGVVGVASAWYLNQAGHEVTVIDREPGAALETSAANAGQISPGYAAPWAAPGVPLKAIKWMFQRHAPLAVRLDGTQFQLKWMWQMLRNCDTSHYMENKGRMVRLAEYSRDCLKALRAETNIQYEGRQGGTLQLFRTEQQYENATRDIAVLEDAGVPYQLLESSRLAEVEPALAEVAHKLTGGLQLPNDETGDCQLFTQNLARMAEQAGVKFRFNTPVDQLLCDGEQIYGVKCGDEVIKADAYVMAFGSYSTAMLKGIVDIPVYPLKGYSLTIPIAQEDGAPVSTILDETYKIAITRFDNRIRVGGMAEIVGFNTELLQPRRETLEMVVRDLYPRGGHVEQATFWTGLRPMTPDGTPVVGRTRFKNLWLNTGHGTLGWTMACGSGQLLSDLLSGRTPAIPYEDLSVARYSRGFTPSRPGHLHGAHS

SEQ ID NO: 473 - DNA, 1248 bp, Unknown
  Obtained from environmental sample
atgcgtaaggatgttgttgttctcggcgctggcatcgtcggcgtatcggccgccattcacctgcagaagcgcggacgctccgttctcctggtcgacaagcgcacgccgggcctcgaaacctccttcggcaatgcgggcctgatccagcgcgagggcgtctatccgtacggcttcccgcacgatttcggcgcgctcctgcgctatgcgctcaacaacaccatcgacgcccattaccatctggcggcgctgccgaagatcgcgcccttcctgttccagtactggatgcattcgcgcccggcgcagcacaaggctatcgcgcgcctctacgcgccgctgatcgagaacagcgtcaccgagcacatggcgctcgccgacgaggcgggctccgcggatctcatccgcccgaccggctggatgaaggtgttccgctccgaaaaggccatggaggagcagcttcgcgatgccgaacaggtcaagcgcgacttcggcgtcaacttcgtcgggctgaacacgaaggacgtggccgagcgggagccgcacctgaaggcggagctgaagggcggcatccactggaccgatccggcagcgatcttcgatccctacaaccttgtcctctcttacgtggagctgttcgagaagctcggcggcgaggtcgcggcgggcgacgccaagaccctcgagcagacctccgacggctggcgcctccagaccgagaagggaccgttcgaagcccgcgacgtagtggtagccctcggcccctgggccgacgtggtgatgaagaagctcggctaccacttcccgctcgcagtgaagcgcggctaccacatgcactacaagcccgagggcaacgcggtgctcaaccgcccgacgctcgatttcgagcgcggctactttctcgccccgatggcgaagggcatccgcctcaccacgggcgcggaattcgccgaccgcgacgcgccgaagaccccggtgcagctccagcgcgccgagccgatcgcacgggccttcttcccgctgggcgagcgggtcgatccggagccgtggatggggatgcgtccctgcacgccggacatgatgccgatcatcggccaggcgccccggcacaaaaatctgtggctcaccttcggccatgcccatcacggcatgacgctgggccccgtcaccggccgcctcatctccgagatgatcacgggccagcccaccatcgtcgatccgaagccctaccggccggagcggttctcggtctga

SEQ ID NO: 474 - protein, 415 aa, Unknown
  Obtained from environmental sample
  DOMAIN (4)...(395): FAD dependent oxidoreductase
  SITE (72)...(75): N-glycosylation site. Prosite id = PS00001
MRKDVVVLGAGIVGVSAAIHLQKRGRSVLLVDKRTPGLETSFGNAGLIQREGVYPYGFPHDFGALLRYALNNTIDAHYHLAALPKIAPFLFQYWMHSRPAQHKAIARLYAPLIENSVTEHMALADEAGSADLIRPTGWMKVFRSEKAMEEQLRDAEQVKRDFGVNFVGLNTKDVAEREPHLKAELKGGIHWTDPAAIFDPYNLVLSYVELFEKLGGEVAAGDAKTLEQTSDGWRLQTEKGPFEARDVVVALGPWADVVMKKLGYHFPLAVKRGYHMHYKPEGNAVLNRPTLDFERGYFLAPMAKGIRLTTGAEFADRDAPKTPVQLQRAEPIARAFFPLGERVDPEPWMGMRPCTPDMMPIIGQAPRHKNLWLTFGHAHHGMTLGPVTGRLISEMITGQPTIVDPKPYRPERFSV

SEQ ID NO: 475 - DNA, 1341 bp, Unknown
  Obtained from environmental sample
atgtcccttgcttttatctgcatcgcgacgaagttcaaaggcaagcctgtatgccggattctggagggcgatgtgagacgccgcgagatcatcattatcggagccgggctggccggggtttccgccgcctggacgctgcgccggcacggccattcggtgacggtgctcgacgccctgtccgggccggcgctggagaccagcttcgccaatgccggcgcgctgacgccgtcggagccggaaccgtggaatgcgccgggtgttgccgggcaattgcttgcctcgctgtttgatcccggcgccgcgatgaaattgcgcctcgcgcccctgcccggcctgatcggctggggcctgcgcttcctgcgcaattccacccatgcgcgccatggcgctgccagcgcagcgaatttcgccctctcgcgctacagccttgccgagacccaggccgtgcgcgatgagctcgggctggaattcgacaatctccgccgcgggacgctgaagctctgccgcagccaggacggtatcgaggcctccatcctggcggcggagaagctggtcccgctcggcctgcgctatgaagtgctcgaccgcgccgcgaccctggagctggaaccacagctggcgggcatcaccgaccagatcgccggctcgatccattatcccgacgacgaatccggcgatgcccatcgcttcacggccgggctggcggcggcggccgaaaaggccggggtcaaattcgaatgggaaacgcgcgtcaccgagttgatggatcgcggcggccatattgtcggcgtccgcaccgagaccgaagagatcgaggccgataccatcatcctcgctgccggccacacggcctggagcctgatgaaaccgctcggcctgcacctgccggtgcgtccagtgaagggctattccctcacattggacatgtccggcctcaatgcccggcccggcacaccggtattcgacgaggcgctgcatgccatcgtcacgccgatgggcaatcgtctgcgcatcgccggcaccgccgagatcgccggcaatgaccggcaattgcgcccggaacgggtggaaaacctcaaatccctggtccgcgccctctatcccgaatttgccgacacgctgctggccggcgagatcaatgcctggaccggcttccggccgatgagcgccgatggccgccccttcatcggcgagacccgcgccaagggcctgtggctgaccaccggccatggtcatctcggctggacccaggcgatgggctcggccgggctgctggccgcattgatggacagcgagacgccgccggtcgatcccgcaccgttcgcggcgagccggatctga

SEQ ID NO: 476 - protein, 446 aa, Unknown
  Obtained from environmental sample
  DOMAIN (29)...(428): FAD dependent oxidoreductase
  SITE (123)...(126): N-glycosylation site. Prosite id = PS00001
MSLAFICIATKFKGKPVCRILEGDVRRREIIIIGAGLAGVSAAWTLRRHGHSVTVLDALSGPALETSFANAGALTPSEPEPWNAPGVAGQLLASLFDPGAAMKLRLAPLPGLIGWGLRFLRNSTHARHGAASAANFALSRYSLAETQAVRDELGLEFDNLRRGTLKLCRSQDGIEASILAAEKLVPLGLRYEVLDRAATLELEPQLAGITDQIAGSIHYPDDESGDAHRFTAGLAAAAEKAGVKFEWETRVTELMDRGGHIVGVRTETEEIEADTIILAAGHTAWSLMKPLGLHLPVRPVKGYSLTLDMSGLNARPGTPVFDEALHAIVTPMGNRLRIAGTAEIAGNDRQLRPERVENLKSLVRALYPEFADTLLAGEINAWTGFRPMSADGRPFIGETRAKGLWLTTGHGHLGWTQAMGSAGLLAALMDSETPPVDPAPFAASRI

SEQ ID NO: 477 - DNA, 1239 bp, Unknown
  Obtained from environmental sample
atgaaggaatcgtacgatgttgttgtagtgggtgggggcgttattggtctttgcagcgcatactatcttcagaaaactggagccagcgtgttggttgtggatagggggcggtataccgaagctgcctccacgggtaacgcggggatgattgtgcccagccacattgtacctctttccgccccgggggttattgcaaagggccttaagtggctgatgaatcctgagagcccgctgtatatcaaacctagcgccaaccctaagttcatgaagtggttgtggctgtttcagaaacattgcacggcggaccatgtggcgtatagcatcccgatattgcgcgatctgagtttgttaagtagggacctctttggcgatttgtgtgctcttcccgggtttgaagatgtaggattggcacacgaaggcctcctaatgctacatcgtagttcatgggcggaaaaagacaatcttgaattagccaatttggcggaaaaagcgggccttgaaattcgccggttgaatgccgcacagacgttggaactggagcccgctttaaagaccgaagtgacaggtgctgtgtattttaagcaggattccagtttacatcctgaacggtttttgcgcgcgatggaaggctatttacgagaagctggagttgacttcttggatggcgaagtcatttcgtttgaacgggctggcgaaaacgtatcggcagtaagaactaagaaacaaatatttaggacacagcatgttgtcctttccagtgggagttgggcgccgcacttggcctcaaaacttggctcttcgattgcggttcaacccgcgaagggatacagcatcaccgttccggtaactgagcctagccttaaaataccgtgcgtcattgccgatgaaaaagtgaccataacacccttgccaggatgtattcgatttggcggtacattggcgcttcaagggtttgataattcgattgatgaacgacgtgcaagtccgattcgtcgtcaagcggaggcatattgcgatgccgcagccgatgcgcctacttgggcgggattcagacctgcttccccggatggtttaccgtttattggatgtttacccaaagcacctaatgtagtagtcgccacggggcatggaatgatgggtgttacactaggccccgtaaccggcctgttggtttctgaattgatctctggcaaaaaacaaagtattgacactgcgccatttagtgcagatagacactaa

SEQ ID NO: 478 - protein, 412 aa, Unknown
  Obtained from environmental sample
  DOMAIN (6)...(394): FAD dependent oxidoreductase
  SITE (236)...(239): N-glycosylation site. Prosite id = PS00001
MKESYDVVVVGGGVIGLCSAYYLQKTGASVLVVDRGRYTEAASTGNAGMIVPSHIVPLSAPGVIAKGLKWLMNPESPLYIKPSANPKFMKWLWLFQKHCTADHVAYSIPILRDLSLLSRDLFGDLCALPGFEDVGLAHEGLLMLHRSSWAEKDNLELANLAEKAGLEIRRLNAAQTLELEPALKTEVTGAVYFKQDSSLHPERFLRAMEGYLREAGVDFLDGEVISFERAGENVSAVRTKKQIFRTQHVVLSSGSWAPHLASKLGSSIAVQPAKGYSITVPVTEPSLKIPCVIADEKVTITPLPGCIRFGGTLALQGFDNSIDERRASPIRRQAEAYCDAAADAPTWAGFRPASPDGLPFIGCLPKAPNVVVATGHGMMGVTLGPVTGLLVSELISGKKQSIDTAPFSADRH

SEQ ID NO: 479 - DNA, 1239 bp, Unknown; identical to SEQ ID NO: 477
  Obtained from environmental sample

SEQ ID NO: 480 - protein, 412 aa, Unknown; identical to SEQ ID NO: 478
  Obtained from environmental sample
  DOMAIN (6)...(394): FAD dependent oxidoreductase
  SITE (236)...(239): N-glycosylation site. Prosite id = PS00001

SEQ ID NO: 481 - DNA, 1251 bp, Unknown
  Obtained from environmental sample
atgggaaaaaacgttttgatcatcggcggaggaattgtgggactctgttctgcatattttttacacaaagaagggcatcaagtaaccgttttggataagtcggatattacttcaggagcctcttttgtcaacgctggatatattactccaagccatattattcctctggcttctccgggaatgattttaaaaggaatcaagtggatgtttagtccaaccagtcctttttatatgcaacccagatgggatatcgacttttttaaatggtcctggtattttcagaaatcttcaacaaaggaaaaggtagcactggccattccgttaattaaagaaattaacctaataagtagggaactttttacagccattaaaaattccggggatttaggagattttcagctggaacgaaagggcttgttaatgttatataaaactgaggctgaaggggaacatgaaatgcgcgtggcggaaaaagcttcctttttaggcctagaagttagtaacttggataagaatactttggataaattgcagccccaggtgaccatggatgttagaggggcaattcattatgagtgtgacggacataccacaccaacagaattcatggagaaaatgctggattatttaaagcgaaacggtgtaatcatcaaaaccaatgaggaggtcacggatatagtgacagataatagccgaataaccaaagtaatttcagaaaagaccgagtattcagccgatgaaattgttttggcggcaggatcttggagcgagaaattatccaaaaaaatgaggctaaaactccccatacaggcaggtaaaggatacagtataaacgtaccgcgcccaaccgggattaccattcctgccattttaatggaagctaaggtagccgtgactcctatgaaggagtatacccgctttgcaggaaccatggaattttctggaataaacgaaataattaataaacagcgcgttgaggctatagccagagcggtcaaggagttttatccaaaaatagaaatcaatgccaaggaaatagctaatgccaaaagtggtcttcgcccagtttctccggatggattgccctatattggaaaaagtagttcccttaaaaatttaactattgccacaggacatgccatgatgggctggagtcttggaccggttaccggacaattggtctcggaaataatatcgaacaaaaaaacatctatggatattgccggcttttccccaaataggaggttctag

SEQ ID NO: 482 - protein, 416 aa, Unknown
  Obtained from environmental sample
  DOMAIN (4)...(397): FAD dependent oxidoreductase
  SITE (377)...(380): N-glycosylation site. Prosite id = PS00001
MGKNVLIIGGGIVGLCSAYFLHKEGHQVTVLDKSDITSGASFVNAGYITPSHIIPLASPGMILKGIKWMFSPTSPFYMQPRWDIDFFKWSWYFQKSSTKEKVALAIPLIKEINLISRELFTAIKNSGDLGDFQLERKGLLMLYKTEAEGEHEMRVAEKASFLGLEVSNLDKNTLDKLQPQVTMDVRGAIHYECDGHTTPTEFMEKMLDYLKRNGVIIKTNEEVTDIVTDNSRITKVISEKTEYSADEIVLAAGSWSEKLSKKMRLKLPIQAGKGYSINVPRPTGITIPAILMEAKVAVTPMKEYTRFAGTMEFSGINEIINKQRVEAIARAVKEFYPKIEINAKEIANAKSGLRPVSPDGLPYIGKSSSLKNLTIATGHAMMGWSLGPVTGQLVSEIISNKKTSMDIAGFSPNRRF

SEQ ID NO: 483 - DNA, 1311 bp, Unknown
  Obtained from environmental sample
atgaaagtaatcgttctgggttcgggcatcatcggcactgctaccgcgtggtttttgcataagtcaggacacgacgtcagcgtgatcgaacgccaacccggcgcagcacaggaaaccagtttcgccaacggttgccagatctccgtatcgcacgccgagccatgggccaatcccgccgcgccgatgaaagtgttgaaatggctgggcaaggaagatgcgccactgctgtatcgcttccgcccggaatggctgcaatggaaatggggcatgcacttcctgcgcgaatgcacgcctgcgcggaccgcttataacatccgccagatcgtcaccatcgccgagtacagccgtcaaaccctgcaaaccctgcgtgctgaaaccggcatcgattacgattgcctgacacgcggcatcctgcacttctataccgatcaaaaggaattcgacgattccctgcccgccgccaacctgatgcgcgaactgggctgcccgcgcgaatcgataggcgcggacgaagtcgtccgcatcgaaccggcgctggctcgtatccgccacaagatcgtcggcggtgactttactgcgaccgacgaatccggcgatatctataaattcaccaccgggctggcaaagaaggcagagcaggcgggcgtcgattttcagttcaacaccacgattacccgcctgttgaaggaaggcactggtgccgctgcaaagatcacgggcgtcgaagtgatcgatgcggaaggcaggcataaggtcttgcgcgccgatgctttcgtcgtcgcgatgggcagcttctccaccacattgctgcaaccgttgggcatcgacctgatggtttatccaggcaaaggctactccgcgacttaccaggtgaccgatagcgccgccgcacccagcgtctcactgactgacgacggccacaagctggtggtgtcgcgcctgggcgaccgcttgcgcgtagcaggaacctgcgaactgaatggctactcacgcgagttgaatacgacgcgctgtgaagcgatcacccgtcgcacgcaagagctttttccggatgcctgcgactacgacaatccggtgtactgggccggcctgcgtccattgacaccatcgaacgtaccgtatatcggcaagacccggtacagcaacctcttcctcaataccgggcatggcacgctgggctggacgatgggcgcaggttcgggccgcgcattggccgacatcatctccggtcgtcaaccggatctcgactttgccttcaccggcatgccgaaacgtgctgcggtgcacgacttagccgtacagccagtctga

SEQ ID NO: 484 - protein, 436 aa, Unknown
  Obtained from environmental sample
  DOMAIN (2)...(407): FAD dependent oxidoreductase
  SITE (224)...(227): N-glycosylation site. Prosite id = PS00001
  SITE (339)...(342): N-glycosylation site. Prosite id = PS00001
MKVIVLGSGIIGTATAWFLHKSGHDVSVIERQPGAAQETSFANGCQISVSHAEPWANPAAPMKVLKWLGKEDAPLLYRFRPEWLQWKWGMHFLRECTPARTAYNIRQIVTIAEYSRQTLQTLRAETGIDYDCLTRGILHFYTDQKEFDDSLPAANLMRELGCPRESIGADEVVRIEPALARIRHKIVGGDFTATDESGDIYKFTTGLAKKAEQAGVDFQFNTTITRLLKEGTGAAAKITGVEVIDAEGRHKVLRADAFVVAMGSFSTTLLQPLGIDLMVYPGKGYSATYQVTDSAAAPSVSLTDDGHKLVVSRLGDRLRVAGTCELNGYSRELNTTRCEAITRRTQELFPDACDYDNPVYWAGLRPLTPSNVPYIGKTRYSNLFLNTGHGTLGWTMGAGSGRALADIISGRQPDLDFAFTGMPKRAAVHDLAVQPV

SEQ ID NO: 485 - DNA, 1269 bp, Unknown
  Obtained from environmental sample
atgaaagtcatcgtattgggcagtggtgtgatcggcacgtcggtggcgtactatctggccaagtccggacaccaagtggaggtcatcgaccgccaagtcggccctgctctggaaaccagctttgccaatgccggtgaggtgtcaccgggctactcatcgccatgggctgggccgggcgtgccggtgaaggccatcaagtggatgctgatgcgccacagcccgctggtgatctggcctttgctggaccccaacatgtggcgctggggcttgtccatgctggccaactgcaccgaaaaagcctatgccaccaacaagagccgcatggtgccgattgccgaatacagccgcgactgcctcaaagagctgcgcgccgagactggcattgcgtatgacgaccgcgcacagggcacgctgcagctgtttcgcacacaggcgcagatggacggcatcgccaaggatgtggaagtgctgcaggactacaaagtgccgttcgaggtgctggaccgcgcaggcttcatcaaggtggaacccgcgctcaagctgacacaggaaaaattcgtgggcgcgttgcgtctacccggcgacgagactggcgactgcttcaagttcaccaaccgcctggctgaaatggccgaggcgcttggcgtcaaatttcgctacaacaccagcatcgacggcattgaggtcagcggcggcaaggtcagcggcgtgcgcaccagcgccggcaccttgacggccgaccactacgtcaccgcactgggcagcttcacaccgcaagtggtcaagcccatcggtatccatatcccggtctacccggtcaagggttactccatcaccgtgccgatcaccgatgccagcggcgcacccgagtccaccatcatggacgaaacgcacaaggtggccgtcacgcgcctgggcgaccgcatccgcgtaggcggaacggccgaactggcgggctttgacatgacgctgcgcgagtcgcgccgcgacacgctgaaccatgtgctgaccgacttattccccaagggcggcgacctgtccaaggccacgttctggtgcggcctgcgccccatgacgccagatggcacgcccatcgtcggacgcacgccctacgccaacatgatgctggccacgggccacggcacactgggctggacaatggcagcgggcacggcacgcgtcatcgacgatttgatctcggggcgcaagccacagatttcactggatggcctgtcgatggatcgttatccacgggcttggcgcggctag

SEQ ID NO: 486 - protein, 422 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVIVLGSGVIGTSVAYYLAKSGHQVEVIDRQVGPALETSFANAGEVSPGYSSPWAGPGVPVKAIKWMLMRHSPLVIWPLLDPNMWRWGLSMLANCTEKAYATNKSRMVPIAEYSRDCLKELRAETGIAYDDRAQGTLQLFRTQAQMDGIAKDVEVLQDYKVPFEVLDRAGFIKVEPALKLTQEKFVGALRLPGDETGDCFKFTNRLAEMAEALGVKFRYNTSIDGIEVSGGKVSGVRTSAGTLTADHYVTALGSFTPQVVKPIGIHIPVYPVKGYSITVPITDASGAPESTIMDETHKVAVTRLGDRIRVGGTAELAGFDMTLRESRRDTLNHVLTDLFPKGGDLSKATFWCGLRPMTPDGTPIVGRTPYANMMLATGHGTLGWTMAAGTARVIDDLISGRKPQISLDGLSMDRYPRAWRG

SEQ ID NO: 487 - DNA, 1263 bp, Unknown
  Obtained from environmental sample
atgacccaagatgttctcgttctcggtgctggtatcgttggcgtatcgacagccattcatcttttgcggcgaggccgttcggtggttcttgtcgacagggccgatccgggcaaggagacctcgtttggcaatgccgggattatccaacgcgaaggcgtgaggccacatgcgtttcctcgcgatcttgcgaccttggttcaggtcggtatgcacttgagcactgccgcgcgctacgatccgctggccctgcccagattcgcgccagcgctggcgcgttattggtgggaatccgcgcccaatcattacaagcgcatcgtcaaaagctatgccccgctgattgcccgctccatcgatgagcatgccgacttcattgccgccgcaggggttgaagacctgatcgtgaaaaagggctggctccttgcctatcgcaccgacaaggctttgggcgaagcgctggaaaacgcgcgcatggatttcgagctttacggcatcaaccaccgcgtcgtggagccgagccaattggcaagcctggaaccgcacctgaaagtcaagatggccggtgccgtacactggacagacccctggaccgtcaagaatcccggcgcactggtcgcggcttatgccgagcttttcaagtccatgggcggcaagatcgtcacaggcgaggcccagcgcctagactcagggaaagatgaatggtcacttgtcctcaaggatcagaccgtcacagcaagagaagctgtcgtgacacttggtccatgggcaccggaatttctggagccgctaggctaccggctgccgcttttcgtcaagcgtggctatcacatgcactacagcacacaaggcaatgcagtgctcaacaactggctgctcgacgccgaagtggggtatctgctcgcgcccatgcaaaatggcattcgtctcacgacaggagccgaatttgcgctgcgcgattcagcgcccacacccgtccagcttggcaaggccgagcgcaaggcacgcgatcttttcccgctggacaagcagctcgatcccaacccgtggaagggcgcccgcccctgcacgccggacatgatgccgatcatcggaccggcaacgaagcacaaggggctgtgggtggcgatcggacatgcccatcatggctttacccttgggccagcaaccggccgggtgctggcggaagccatgaccggcgagcagccggtcatagacatcaagcccttctcgatggaacggtttaccggcaattcgatcaggaattaa

SEQ ID NO: 488 - protein, 420 aa, Unknown
  Obtained from environmental sample
  DOMAIN (4)...(395): FAD dependent oxidoreductase
MTQDVLVLGAGIVGVSTAIHLLRRGRSVVLVDRADPGKETSFGNAGIIQREGVRPHAFPRDLATLVQVGMHLSTAARYDPLALPRFAPALARYWWESAPNHYKRIVKSYAPLIARSIDEHADFIAAAGVEDLIVKKGWLLAYRTDKALGEALENARMDFELYGINHRVVEPSQLASLEPHLKVKMAGAVHWTDPWTVKNPGALVAAYAELFKSMGGKIVTGEAQRLDSGKDEWSLVLKDQTVTAREAVVTLGPWAPEFLEPLGYRLPLFVKRGYHMHYSTQGNAVLNNWLLDAEVGYLLAPMQNGIRLTTGAEFALRDSAPTPVQLGKAERKARDLFPLDKQLDPNPWKGARPCTPDMMPIIGPATKHKGLWVAIGHAHHGFTLGPATGRVLAEAMTGEQPVIDIKPFSMERFTGNSIRN

SEQ ID NO: 489 - DNA, 1242 bp, Unknown
  Obtained from environmental sample
atgagcaaagacgtcatcgtcctcggcgccggcatggtcggcgtatcaacggcgctgcacctgcagcagcgcggccgctcggtggcgctggtggaccggcgtggcgtcgccgaggagacctcctacggcaacgcaggcatcatccagcgcgaaggcatcgtgccttacctctttccgcgcgaatgggccacgatcctgcgttacgcgcgaaaccagtctacagacgcagccttccagtggtcgtcgctgccgcgcgtggcgccgtggctgttccgctattggcgctggtcgaccgaagcgggcatgcacgcgaccgcgcgcgcgatggcgccgatcgtcacgcgttgcgtcgacgagcacgaagcgctgatgaatgccgccggagtcatcggcatgatccggcgcaccggctacctgcgcgtctatcgtacggagcagaccctcgaaaaggcaatccgcgaggatgccgagatcaagtccaagtacggagtcgtgaccaagccggtgacgccggcgcagctcgcggagctcgagccgcacttgaagccagtgttcgccggcggcgtgctgctgcccgatccatgcagcgtcgccgatccgaacgctctcggcaaagcctacgccgagctgttcgtgaaacgtggcggcgcgctcgtcgaaggcgaggcgcggtcgctggcgcaggatggtgccggctggaaggtcgcgacgcgcgatggctggatctcggcgccgaacgtcgtcgtagcgctggggccgtggtcggatacggttacccgcgcgcaggggcttcgcctgccgcttggagtcaagcgcggctaccacatgcattaccgaccggaaggcaacgcaacgttgagccggccggtcatcgatgggtcagtcggctttgccatggcgccgatgaccaagggtattcgcgtgacgacgggtgcggagttcgcaaccatcgatgcaccagcaaatacggtgcagctcgagcgcgtcgagccgctggcgcgcgccgcctttccgctcgccgagcgtgcggagcccacgccgtggctcgggcggcgtccgacgttccccgacatgctgccggtgatcggcgaagcagcgaaccggaagggcctttggatgaacttcggccaccaccatctcggcttcacgctcggcccggtgacaggccgcctcctcgccgaggtgatgacgggcgagaagccgttcaccgatccccatccctatcgcgccgagcgattctag

SEQ ID NO: 490 - protein, 413 aa, Unknown
  Obtained from environmental sample
  DOMAIN (4)...(395): FAD dependent oxidoreductase
  SITE (72)...(75): N-glycosylation site. Prosite id = PS00001
  SITE (287)...(290): N-glycosylation site. Prosite id = PS00001
MSKDVIVLGAGMVGVSTALHLQQRGRSVALVDRRGVAEETSYGNAGIIQREGIVPYLFPREWATILRYARNQSTDAAFQWSSLPRVAPWLFRYWRWSTEAGMHATARAMAPIVTRCVDEHEALMNAAGVIGMIRRTGYLRVYRTEQTLEKAIREDAEIKSKYGVVTKPVTPAQLAELEPHLKPVFAGGVLLPDPCSVADPNALGKAYAELFVKRGGALVEGEARSLAQDGAGWKVATRDGWISAPNVVVALGPWSDTVTRAQGLRLPLGVKRGYHMHYRPEGNATLSRPVIDGSVGFAMAPMTKGIRVTTGAEFATIDAPANTVQLERVEPLARAAFPLAERAEPTPWLGRRPTFPDMLPVIGEAANRKGLWMNFGHHHLGFTLGPVTGRLLAEVMTGEKPFTDPHPYRAERF

SEQ ID NO: 491 - DNA, 1290 bp, Unknown
  Obtained from environmental sample
atgaagatctcgatcgtcggtgccggccttgccggtctttgcgcggcgcacgcgctggtcgccgccggcgcgacgcgcgtcgacgtcttcgaccgcgccgccggcccgggcctggaaaccagcttcgccaacggcgcgctgctgcatccgagcgcggtcgatccctggaactcgcccggcatcaccggcacgctgatcggcagcctgttcgatgccgatgccgcgttccggctgcacccgcgggtgctgccgtccttgtggggctgggggtggcgctttctgcgcgagtcacgccgcgaccggtacgaaacccatggcctggccaatctggcgctggcacggctcagcgtgcagcgcatggccgcgctgcgcgacgaaggcatcgcctatggctgcgatcggcgcggctcgctcgcaccgtaccgggatgcggcgggttttgccgccgcttgcacgcgcgccgagcgcctggccgggttcggtctggaacatcgggtgctcgatcgtgaagcgatgctggcgctggagccggcactggccgcgatcgctgcgcagaccgtcggtgcgctgcacttcccgcacgacgaacaaggggatgcccatgccttctgcaatgcgctggcggcgcggctggcgcagcagggcgtgttgttccactggggcaccgaggtgcgcgcgctgcgcaccgtgggcagcgcggtgcggggcctcgagttggccgatggccgccgcgacgacgccgaccgggtggtgctggccgcggcagcgtggagcgcggcgctgacacgtccgctcggcctgcagctgccgctgcgcccggccaagggctactcgatcagcttcacgctcggcagcctggcggacggatcctcacctcccaacgtcccacgcatgccgatcgtcgaccatgatctgcacatcgccgcggtgccggtggccggtggccgcctgcgcgtggccggcaccgccgagctggtgggcttcgaccgccgcatcgatccgcgccgcaccgcattgctgttgcgccggttgcaccggctttacccggcgctggtgcccttgctcgacgcagcgccgcgccaggactggaccggcctgcgcccgctctcggccgacggcgtaccgctgatcggccccacccggatcggcggcctgtggctgaacaccgggcatggaccgatcggctggaccaccggcgtggcctcgggcgaactgctggccgacgcgatcttcggccgccgctctgcgatcgatccgacacccttcctgccgcagcgcttcgggctctga

SEQ ID NO: 492 - protein, 429 aa, Unknown
  Obtained from environmental sample
  SIGNAL (1)...(21)
  DOMAIN (2)...(409): FAD dependent oxidoreductase
  SITE (383)...(394): Lipocalin signature. Prosite id = PS00213
MKISIVGAGLAGLCAAHALVAAGATRVDVFDRAAGPGLETSFANGALLHPSAVDPWNSPGITGTLIGSLFDADAAFRLHPRVLPSLWGWGWRFLRESRRDRYETHGLANLALARLSVQRMAALRDEGIAYGCDRRGSLAPYRDAAGFAAACTRAERLAGFGLEHRVLDREAMLALEPALAAIAAQTVGALHFPHDEQGDAHAFCNALAARLAQQGVLFHWGTEVRALRTVGSAVRGLELADGRRDDADRVVLAAAAWSAALTRPLGLQLPLRPAKGYSISFTLGSLADGSSPPNVPRMPIVDHDLHIAAVPVAGGRLRVAGTAELVGFDRRIDPRRTALLLRRLHRLYPALVPLLDAAPRQDWTGLRPLSADGVPLIGPTRIGGLWLNTGHGPIGWTTGVASGELLADAIFGRRSAIDPTPFLPQRFGL

SEQ ID NO: 493 - DNA, 1344 bp, Unknown
  Obtained from environmental sample
atgcaagcactcgtcatcggcggcggcatcatcggcctgagcaccgcgtactacctgcgggaatccggctgggaggtgaccgttttggaaaaaggcgacctcaccgacaactgctcgttcggaaacatgggctacctgtcgccctcgcacttcgtgcccttggccgcgccgggcatgatcgagcagggcctcctgtggatgttcgatcccaaaagcccgttctacgtgcgcccgaggctgagctgggaactggcggactggggcctgaaattcatgcgggcctccacccgctcccacgtcgagcgcagcgcccgcccgctcgcggatttgctgctgctctcgaaacaattgatgcgcgattgggcggccacggacggcttcgattttgaactgaccgagcgcggctgcatgatgtatttccaaacggaaaaaaccgagcgcgaggaactcgaaaatgcccgcaaggccgaagacctcggcctgcacgtagaagtgctgggccgggaacaggtgcagatcatcgaaccggacgtgcggcccgacgtgcgcggcggggtgttgttcaaggacgacgcgcacctgtaccccaacgcgctcatgcagcagctgccggccgtgctggaaaaacgcggcgtgcggatcatccgaaacgccgaggtcgtgggtttcgaccgcgccaaaggcaaaatcaccgccgtccactaccgcacccccaactcaaccccgccttcggctgggcaagcactcaaaacttctttgtcacccccgcagggggcaaaactcaaaactgatctcctgattttggccgccggctcctggtcgccccaactggcgcgcatggccggcgagtacctgccgctcatgcccggcaaaggctactccatgaccgtggacaaccccgccaaaaaactccgctacccttgcatcctgctggaggccaaggtagcgctcacgccgtgggccaatcgcctgcgcatcggcagcacgatggagatcgggccgatcaacgaccgcatcctgttcccccgcgtgcagggcatcctcgaggccgtgccgcgctacctgccgggctttttggacgatcccgagtaccgggcgctcgccgatctggatgcgctgcgccaaaacctgcgcgaaaaggtctggtttggcttccggcccgtatccgccgacggcatgccctacatcggctacgcccggaaaaacgccaacctgatcatcgccacgggccacgccatgctgggcgtgagtttggccgccgggacgggaaaattggtggctgaattggccgatggtcaaggcaccacagtgcccgcacaggcgtttgatccgtgccgatactga

SEQ ID NO: 494 - protein, 447 aa, Unknown
  Obtained from environmental sample
  DOMAIN (2)...(429): FAD dependent oxidoreductase
  SITE (37)...(40): N-glycosylation site. Prosite id = PS00001
MQALVIGGGIIGLSTAYYLRESGWEVTVLEKGDLTDNCSFGNMGYLSPSHFVPLAAPGMIEQGLLWMFDPKSPFYVRPRLSWELADWGLKFMRASTRSHVERSARPLADLLLLSKQLMRDWAATDGFDFELTERGCMMYFQTEKTEREELENARKAEDLGLHVEVLGREQVQIIEPDVRPDVRGGVLFKDDAHLYPNALMQQLPAVLEKRGVRIIRNAEVVGFDRAKGKITAVHYRTPNSTPPSAGQALKTSLSPPQGAKLKTDLLILAAGSWSPQLARMAGEYLPLMPGKGYSMTVDNPAKKLRYPCILLEAKVALTPWANRLRIGSTMEIGPINDRILFPRVQGILEAVPRYLPGFLDDPEYRALADLDALRQNLREKVWFGFRPVSADGMPYIGYARKNANLIIATGHAMLGVSLAAGTGKLVAELADGQGTTVPAQAFDPCRY

SEQ ID NO: 495 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgttcgcgttgttcagcaattcggccgaaccccggctgcgcgagaacggcgcggccatccaatcgttgacggcgcacgcgcccgcaatgcatgaggccttgctgatcgaggccggcagggcggacctgttgcgcaagacaggctggctacagctttacgcgagcgatgccgcattcgccgccgatagcctgaaacggcgtatcgccgatgaggcaggatgcgactattcggtgctcgacactgaagccgccaaggagctcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggacctgttgcgcccgctcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgcgacccattatcggacctgcgccgcgccatgacggattgtggctgaatttcggccatgcccatctcggctataccctgggcccggtctccgcgcggctactggccgagttgataaacggagattcgccgatcagcgatccggcgccattcgccccgacgcgtttctga

SEQ ID NO: 496 - protein, 417 aa, Unknown
  Obtained from environmental sample
  DOMAIN (9)...(399): FAD dependent oxidoreductase
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLFALFSNSAEPRLRENGAAIQSLTAHAPAMHEALLIEAGRADLLRKTGWLQLYASDAAFAADSLKRRIADEAGCDYSVLDTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAPTRF

SEQ ID NO: 497 - DNA, 1263 bp, Unknown
  Obtained from environmental sample
atgacccaagatgttctcgttctcggtgctggtatcgttggcgtatcgactgccattcatcttttgcggcgcggccgttcggtggttcttgtcgacagggccgatccgggcaaggagacctcgtttggcaatgccgggattatccaacgcgaaggcgtgaggccacatgcgtttcctcgcgatcttgcgaccttggttcaggtcggtatgcacttgagcactgccgcgcgctacgatccgctggccctgcccagattcgcgccagcgctggcgcgttattggtgggagtccgcgcccaaccattacaagcgtatcgtcaagagctacgccccgctgattgcccgttccatcgatgaacatgccgatttcattgccgctgcaggcgttgaagaccttatcgtgaaaaagggctggctccttgcctatcgcaccgacaaggctttgggcgaagcgctggaaaacgcgcgcatggatttcgagctttacggcatcaaccaccgcgtcgtggagccgagccaattggcaagcctggaaccgcacctgaaagtcaagatggccggtgccgtacactggacagacccctggaccgtcaagaatcccggcgcactggtcgcggcttatgccgagcttttcaagtccatgggcggcaagatcgtcacaggcgaggcccagcgcctagattcagggaaagatgaatggtcacttgtcctcaaggatcagaccgtcacagcaagagaagctgtcgtgacacttggtccatgggcaccggaatttctggagccgctaggctaccggctgccgcttttcgtcaagcgtggctatcacatgcactacagcacacaaggcaatgcagtgctcaacaactggctgctcgacgccgaagtggggtatctgctcgcgcccatgcagaatggcattcgtctcacgacaggagccgaatttgcgctgcgcgattcagcgcccacacccgtccagcttggcaaggccgagcgcaaggcacgcgatcttttcccgctggacaagcaactcgatcccaacccgtggaagggcgcccgcccctgcacgccggacatgatgccgatcatcggaccggcaacaaagcataaggggttgtgggtagcgatcggacatgcccatcatggctttacccttgggccagcaaccggccgggtgctggcggaagccatgaccggcgagcaaccggtcatagacatcaagcccttctcgatggaacggtttaccggcaattcgatcaggaattaa

SEQ ID NO: 498 - protein, 420 aa, Unknown; identical to SEQ ID NO: 488
  Obtained from environmental sample
  DOMAIN (4)...(395): FAD dependent oxidoreductase

SEQ ID NO: 499 - DNA, 1245 bp, Unknown
  Obtained from environmental sample
atgaaattcgacgtcgccgtgcttggcgcgggcattgtcggcatctcgacggccctgcatttgcaggcgcgcggcgcttccgttgcgctggtcgaccggcgcgggccgggcgaggagacgagcttcggcaatgccggcatcatccagcgcgagggcgtgcacccctatctcttcccgcgcgactggcggcggctcgcgcgcaccgcgctggggcgagggacggaggcgcgctaccagactgcctcgctgccgcatgtggcgggcttcctgtggcgctactggcgcgcctcggcgcccgagcaggcgcggcgcacgctggccgccaacatccccctgttcgagcgttgccttgtcgagcatggcgaactggcggaggcgtcgggggccggaaacctgatcgcaaaaggcggctggatcggattgttccggcagatggagcgggcgcgccgggccgagccagagattgccgaactgaagagcatgggccttgacgtggcgatgctgacgccgggcgagttcgccaggcttgagccgcatgtcgcgaccgaaaggctggcggcggcggtgcactaccgtgacccgtggacggtcagcgatccgggagcgctctcgaaagcctatgccgcgctgtttgcggcgcggggcggcaaaatggtcaccgccgacgcgcgcacgacgcgacgcgatggccaaggatggaagatcgacggcgcggagccggtcgaggcgcagcgcatcgttgttgcgctggggccgtggtcgaagccgttcctcgacatgcacgggctgcgcctgccgatgggcgtcaagcgcggctatcaccgccactaccggccggggccgggcgcgggattgaaccggccggtcatcgacgaggaggcgggcttcgttctcgcgccgatggcgcgcggcataaggctcaccaccggggcggagttcgccgcgctcgacgcgccggcgcgccccgttcaggtcgagcgctgcctgccgattgcgcgccagtggctcgatctcgccgacagtccggacgcgcaggcatggctcggggcgcggccggcatttcccgacctcctgccggcaatcgggcaagcgccgggcttgcccggcgtcttcctcaatttcggccatgcccatcacggactgacgctcgggccggcgacgggccgcctgctcgccgagatcatgagcgggcagacggctttcaccgaccctgcgccgtatggcgcggggcggttttcaggctga

SEQ ID NO: 500 - protein, 414 aa, Unknown
  Obtained from environmental sample
  SIGNAL (1)...(23)
  DOMAIN (4)...(394): FAD dependent oxidoreductase
MKFDVAVLGAGIVGISTALHLQARGASVALVDRRGPGEETSFGNAGIIQREGVHPYLFPRDWRRLARTALGRGTEARYQTASLPHVAGFLWRYWRASAPEQARRTLAANIPLFERCLVEHGELAEASGAGNLIAKGGWIGLFRQMERARRAEPEIAELKSMGLDVAMLTPGEFARLEPHVATERLAAAVHYRDPWTVSDPGALSKAYAALFAARGGKMVTADARTTRRDGQGWKIDGAEPVEAQRIVVALGPWSKPFLDMHGLRLPMGVKRGYHRHYRPGPGAGLNRPVIDEEAGFVLAPMARGIRLTTGAEFAALDAPARPVQVERCLPIARQWLDLADSPDAQAWLGARPAFPDLLPAIGQAPGLPGVFLNFGHAHHGLTLGPATGRLLAEIMSGQTAFTDPAPYGAGRFSG

SEQ ID NO: 501 - DNA, 2334 bp, Unknown
  Obtained from environmental sample
aaagaattcggcacgagcggcgtcggcgaggcgatggatatcgaaatgctccagggcatggctcccgcgcaggctgccgccgttcgcgccgaagtcgccctagacggcgggcgtgtcgtcctgtacacccccgccgtgcgtgacgaagacttcgacgtggccatcagctacctggtgcgtcgcctcgaagaaaacgccgcctcgcagaacttcctccacgcccagttcgctggcggccagggcgccatcgcaggccaggaggccgctttccgtaccgccgtcgctgctgccgttccgttcgcgccagaggccatcgccccgcgccgcaccccgcgctcgcagtggccgaatattgccgacgagatcgccgccgatggggtgttccgcaactccatcgacaccgaccctgccgtagctgcgcaccgaaacggcgccgccatcattatcgaccgtgaacagtccgggtacaagcctgttcagacgctgatgacgacggacgctgagactatcgacgctgcgctcacccgatccgtcgccgttcagcaggtatgggcagccgtgcccgctgccgcccgcgccgaggcgcttcacgccatcggacgtcgtttggaggccgcccggttcgacctcgtcgctgccgaagttcacgaggctggcaagacggtcgcagaagcagacccggaggtgacggaggccatcgacttcgcccactactacgctggctccgcgctcaccctcgacggggtgacaggcgcgaacttcacacccgacggagtcacgctcgttaccccgccgtggaacttccccgtcgccattcctgcaggcggtgtgcttgcggcgctcgcggccgggtcatccgttatcgcgaaaccggcttcgccgaccccgcgctgtttcgaacttgtcattgaggccgttcacgctggtcttgacgatgcgtcggcgacgaccggcttaacccctgagcagaaccgcgacatcgtccagtttattcgcgtctccgagcggtcgcttggtaagcagttggtcacccatgatgcggtggcccgcgtcatcctcaccggctccatcgagacagcggaacttttcgcgtcgtggaagcccgagcgtcccgtgcttgcggaaacctccgggaaaaactccatcattgtcaccgcgtcctccgacatcgacctggccgtcgctgacgtgctgcggtccgccttcggacatgccgggcagaagtgctccgctgcttcgttggcgattctcgtcggctccgtcggcgacccgaagtctgcgacgggcgaacgcttccgccgtcaactcatcgacgccgtgaagtccctggccgttggcgcaccgaccacgctgtccactgtcatgggtccgctgaccgagcctgctggtgagaagttaacccgggcgctgaccacactcgagccgggggagacgtggctggtcaagcccgaacttcttgacgagcaggcggctgccgcaggcctcggtgaaaaccgcctgtggacgcctggcctgcgcgacggtgtcaagcccggttcatggttccacctcaccgaagcgtttggtccggtgctcggcctgatgacggcccgcacacttgaggaggctatcgagttacagaacgccaccgcgttcgggctcaccgccggcctgcactccctcgacgacgatgagatcgccctgtggaaggaccgcgtccaagccgggaacctctacatcaaccgccacatcaccggtgctatcgtccagcgtcaaagcttcggaggctggaaggcctcgtcggttggccccggcgcgaaggctggcggtccccactatgttgcgatgctcggccagtgggccgacgctgccgatgtcccctcgcgcgatactgactcggctgcgtggttggagtgggcgaaggccgatgacacccgcgtgtgggcgcagttgtcgaaggaggtcgacttgtctgggctcgtcagcgaggagaacaccttccggatgcgtcccatcgacgcgctgaccatccgcgttggtgacggcgcactgcccgtcgaggtggagcgtgtgcgcaacgccgcctggacggcaggtgttgagtccgtcgtgatcccagttcacgacatgacacacgaagtcttcgccgccgccgtcgcgtctggtgacatctcaggccgcatccgcgttatcggcgcagcgcctggcctacacgaggccgccgcgacggttctcggctcaacgacggtgctcgacgccccggttgtcgcctcgggtgcccgcgaactgctcaacgtgctccgtgaacaggccgtcagccgcaccaaccaccgttatggccacattaagcactga

SEQ ID NO: 502 - protein, 777 aa, Unknown
  Obtained from environmental sample
  DOMAIN (148)...(613): Aldehyde dehydrogenase family
  SITE (131)...(134): N-glycosylation site. Prosite id = PS00001
  SITE (408)...(419): Aldehyde dehydrogenases cysteine active site. Prosite id = PS00070
  SITE (549)...(552): N-glycosylation site. Prosite id = PS00001
KEFGTSGVGEAMDIEMLQGMAPAQAAAVRAEVALDGGRVVLYTPAVRDEDFDVAISYLVRRLEENAASQNFLHAQFAGGQGAIAGQEAAFRTAVAAAVPFAPEAIAPRRTPRSQWPNIADEIAADGVFRNSIDTDPAVAAHRNGAAIIIDREQSGYKPVQTLMTTDAETIDAALTRSVAVQQVWAAVPAAARAEALHAIGRRLEAARFDLVAAEVHEAGKTVAEADPEVTEAIDFAHYYAGSALTLDGVTGANFTPDGVTLVTPPWNFPVAIPAGGVLAALAAGSSVIAKPASPTPRCFELVIEAVHAGLDDASATTGLTPEQNRDIVQFIRVSERSLGKQLVTHDAVARVILTGSIETAELFASWKPERPVLAETSGKNSIIVTASSDIDLAVADVLRSAFGHAGQKCSAASLAILVGSVGDPKSATGERFRRQLIDAVKSLAVGAPTTLSTVMGPLTEPAGEKLTRALTTLEPGETWLVKPELLDEQAAAAGLGENRLWTPGLRDGVKPGSWFHLTEAFGPVLGLMTARTLEEAIELQNATAFGLTAGLHSLDDDEIALWKDRVQAGNLYINRHITGAIVQRQSFGGWKASSVGPGAKAGGPHYVAMLGQWADAADVPSRDTDSAAWLEWAKADDTRVWAQLSKEVDLSGLVSEENTFRMRPIDALTIRVGDGALPVEVERVRNAAWTAGVESVVIPVHDMTHEVFAAAVASGDISGRIRVIGAAPGLHEAAATVLGSTTVLDAPVVASGARELLNVLREQAVSRTNHRYGHIKH

SEQ ID NO: 503 - DNA, 1263 bp, Unknown
  Obtained from environmental sample
atggtgaaacagggcaagggtcccaccgttgtcatcggcggcggcgtcattggggcgatgtgcgcttggtacctgtcaaagactggttacgacgtcacgatcgtcgaccgcggcctgtttgcatcggggtgttcccacggcaattgtggttacatcagccccagccatattctgccgttgaccacgccgggcgcggtacgaatggcgctcaggtcgatgatctcgagcgagtcccctttttacgtaaagccccgtttttctccggcgatgtggcaatggatgtggcgattcgcgcggcgctgtaatgaacgggacatgttggaagccgccgacgtcttgcatccgctgctgcaatccgccaagcaactctatatcgaattgattgagggtgagcggctcgattgcgaatggcaggacacggggatcattttcgttttccagagcgaacacggttttcggcactacgaacaaatcgactccctgttgggaaagcgttacggcgtctccgccaaaccgttggacagccggcaactcgcggcgttggatccggctttaaaccccggtctgggcggcggatggttttacgagtgcgacgcgcatttacggcccgataaactaatggcggaaatgaaacgcaaactcgtcgaacgcggcgtggaaatccttgaaaaccaaccggtcgagagctttgtcgtcgaagcgggccgcgcccgttcggtgctgacgtcgcaaggcgaaattgaaggcgctcaattcgtcgttgccacgggttcctggacgccgtttctcaatcgatatttggggcgccgcgtcccgattcagccgggtaaaggctattcgttgacgatgccgaggccgactctatgccccaagtattcgatgattttcgaggaacatcgcgtcgcgatcacgccgatgatgagcaaatttcgcatcgggtcgacgatggagttcgcgggatacgacacgacgatcaatccacgcagaattgcattgctgaagaaagcggccaagctgtacttgcgcgaaccccatttggatcttgtcgaagagacctggtacggctggcggccgatgacttgggacagcaagccgttcattgatcgcgctccggcgatgagcaacacttgggtggccgcggggcataatatgcttggactctccttggctacggtgaccggcaaattgatcgccgaactcgtcaacggcgatcggccacacctcgacgtgaaaccgcttagtttcgcccggctcatggattga

SEQ ID NO: 504 - protein, 420 aa, Unknown
  Obtained from environmental sample
  DOMAIN (8)...(400): FAD dependent oxidoreductase
MVKQGKGPTVVIGGGVIGAMCAWYLSKTGYDVTIVDRGLFASGCSHGNCGYISPSHILPLTTPGAVRMALRSMISSESPFYVKPRFSPAMWQWMWRFARRCNERDMLEAADVLHPLLQSAKQLYIELIEGERLDCEWQDTGIIFVFQSEHGFRHYEQIDSLLGKRYGVSAKPLDSRQLAALDPALNPGLGGGWFYECDAHLRPDKLMAEMKRKLVERGVEILENQPVESFVVEAGRARSVLTSQGEIEGAQFVVATGSWTPFLNRYLGRRVPIQPGKGYSLTMPRPTLCPKYSMIFEEHRVAITPMMSKFRIGSTMEFAGYDTTINPRRIALLKKAAKLYLREPHLDLVEETWYGWRPMTWDSKPFIDRAPAMSNTWVAAGHNMLGLSLATVTGKLIAELVNGDRPHLDVKPLSFARLMD

SEQ ID NO: 505 - DNA, 1266 bp, Unknown
  Obtained from environmental sample
gtgagtcgtcgagctatcgtcgttggcggaggcgtgatcggtgcaggatgcgcgcattatctgaccgaatctgattggcaagtgacgattgtcgaacgaaagacgttcgggtgcggagcatcgcacgcgaattgcggtctgatttcgccgagccacatccttcccttgcccggcccaggtgtcattggcaagacaatgaaggcgatgtttagcccgaattcgcctttctcaatcaaaccacggcttgatccggcgctgtggagttggctgctccagttcgctcgccattgcaacatgagcgatttcattcgcggcggtaaaactctgcaagcgatgctgaattcctcgcgttcgctttacgatgatctcttcgccaataatccgctcgacgccgaattccagcacgccggtgtcctttttccctttctgagcaaagcagggatggaacacttcggcgagaacaatcaacttcttcgcgaacactttggagcgggcgcccaacgatacgatggtgacgatgtttcgaagctcgaacccgccttgaaaaccggcttggctggcggttggtatttctcagaagacgcgcacttgaagcctgacaaactgatgtcctcttggcgcaaagtgctggagtcgcgcggcgtaacagttctcgaaaatcgagagatcaccggcttcggcaaacaggatcccaatggcgccgccggcaatcgaaaagtcaccaccgtaaagacgccccaaggcgaaatcgaaggcgatgtcgtcgtggtcgcgactggagcctggacgccgttgctgaattccgagctcgaatgcaaggttccgattcaacccggcaagggctattcgctgacgatggctcgaccgtcgatctgcccgaagattccgatgatcttcgaggaacaccgtgttgcggtcactccatggccgtccggttatcggttgggttcgaccatggagtttgctggctatgattcgaaactgaatccgcgccgcatcatgttgctcagaaacggtgccagccattacctgcacgaaccgactgcggaacccgttgtcgaagaatggtgtggctggcgaccaatgacccctgatagcctgccgattatcgatcgatgcccagcctttgataacgtattcttggcggccggccacaacatgctaggtgtctccatggcgccggtaaccggaaagctgattgccgaactgatcaacggaaaaactccccacttgccgatcgaaccgatgtcgatcaggcgattttga

SEQ ID NO: 506 - protein, 421 aa, Unknown
  Obtained from environmental sample
  DOMAIN (4)...(403): FAD dependent oxidoreductase
  SITE (36)...(42): Immunoglobulins and major histocompatibility complex proteins signature. Prosite id = PS00290
  SITE (99)...(102): N-glycosylation site. Prosite id = PS00001
  SITE (115)...(118): N-glycosylation site. Prosite id = PS00001
MSRRAIVVGGGVIGAGCAHYLTESDWQVTIVERKTFGCGASHANCGLISPSHILPLPGPGVIGKTMKAMFSPNSPFSIKPRLDPALWSWLLQFARHCNMSDFIRGGKTLQAMLNSSRSLYDDLFANNPLDAEFQHAGVLFPFLSKAGMEHFGENNQLLREHFGAGAQRYDGDDVSKLEPALKTGLAGGWYFSEDAHLKPDKLMSSWRKVLESRGVTVLENREITGFGKQDPNGAAGNRKVTTVKTPQGEIEGDVVVVATGAWTPLLNSELECKVPIQPGKGYSLTMARPSICPKIPMIFEEHRVAVTPWPSGYRLGSTMEFAGYDSKLNPRRIMLLRNGASHYLHEPTAEPVVEEWCGWRPMTPDSLPIIDRCPAFDNVFLAAGHNMLGVSMAPVTGKLIAELINGKTPHLPIEPMSIRRF

SEQ ID NO: 507 - DNA, 1254 bp, Unknown
  Obtained from environmental sample
atggccgaacacaaggctgacgttctcgtgctcggtgccggcatggtcggtgtcggcgccgcgctgcacctgcaacggcgcgggcgcgacgtcatcctggtcgaccggaatgagcttgcgggcgaggggacgagctacggcaatgccggaatcatcgaatgcgcctcggtattcccctacatgtttccccgcgatgtcggggaaattctctattatgcgaccaatcgcgcgccacacgtccgttatcggctcgccgacctgccgtcgttcctgccctggctcctgcgctattatctcgcttccgagccgtcgcgtgccttgcgcggcgcgatgggcgtgctgccgctgatccggcgcagtctcgtcgaacatgaggcgctgatcgcggaagccggcgtgccggagctgctgcgcaaggacggctggatcaagctgttccgatcagcgaaaaccatggacaaggccatcgccgaactggaacgggcgcgacaatatggcgtagagggcgatgtcctcgatgccgctggtatcgccgcgcgcgagccgcatcttgccggcgatttcaccgctgccatccatttcacccagccggggttcgtgcccgatcccggcgggctcgccaagggctatgccgcgctgttcaagcgcaagggcgggcgtttcctggtggcggatgcgaccacgctcgaaccggcgggcaatggctggcgcgtgagcggggcgggcgacagcgcggtggcgcacgaggcggtgatcgcgctcggcccatggtccgatctggtgttcgagaagctcggctatgccctgccgttctcggtcaagcgcggctaccatctgcatctggcgccgcgcggcaacgccgtgctgcggcgtcccgtgctcgatgccgaccagggtttcttgctggcgccgatgaaccgcggcattcgcctgaccaccggcgtcgaattcgcccgccgcgacgcgccggagaatttcgcgcaggtcgaagccgcgctgccgaaggcgcatgcgctgtttccgctcggcgaggcggtggatgcaaagccgtggaagggcgcgcgcccgtgcctgcccgacatgctgccggtcatcggcaaggcgccgcgccatccgggattatggttcgacttcggccatcagcatcacggcctgacgcttgggccggtgacggggcgcctgctcgcggagatgatgacgggcgaaacgccgttcgccgaccccgcgccgttttcgccggacaggtttgggtaa

SEQ ID NO: 508 - protein, 417 aa, Unknown
  Obtained from environmental sample
  DOMAIN (7)...(398): FAD dependent oxidoreductase
MAEHKADVLVLGAGMVGVGAALHLQRRGRDVILVDRNELAGEGTSYGNAGIIECASVFPYMFPRDVGEILYYATNRAPHVRYRLADLPSFLPWLLRYYLASEPSRALRGAMGVLPLIRRSLVEHEALIAEAGVPELLRKDGWIKLFRSAKTMDKAIAELERARQYGVEGDVLDAAGIAAREPHLAGDFTAAIHFTQPGFVPDPGGLAKGYAALFKRKGGRFLVADATTLEPAGNGWRVSGAGDSAVAHEAVIALGPWSDLVFEKLGYALPFSVKRGYHLHLAPRGNAVLRRPVLDADQGFLLAPMNRGIRLTTGVEFARRDAPENFAQVEAALPKAHALFPLGEAVDAKPWKGARPCLPDMLPVIGKAPRHPGLWFDFGHQHHGLTLGPVTGRLLAEMMTGETPFADPAPFSPDRFG

SEQ ID NO: 509 - DNA, 1245 bp, Unknown
  Obtained from environmental sample
atggcacgtaccgatgcaattgtgatgggcgccggcattgtcggtacatcgatcgcgctgcatctggtcaagcggggcctctccgttgcgctgatcgatcgcgccggcattggcgagcaaacgtcctacggcaattctggcgtgatcgagggcagcacgattctgccgccggcattcccgccgggtctgagcgggctcctgcgcgcggcgttcaagcgcggcagcgacgccaactaccatttcggctttctgccgcaggtggcgccgtggctgtgggcgtttcgcgcagcatcgcggccggacaggcttgccgaaaccgcgcggctgaaccggccgctgtttgccgccgccattcccgagcacgaagcgctgatgctcgagtccggcgcgacgaagtacctgcgtaagaccggatggctcaagctctatcgcaacgaggcgagcttcaacgccttgcaggcggaattcgaactggcgaaggagtttggattgccgctcgaggcgctcgatgcggaaggcgtgcaggcgctggagccatcgctgcgtcccgtgtttgcgcgcggcgtgttctggccgaaggccgcgagcctgagcaacccgctggccgtaacgcgtgcttatgccaaacgttttagcgatctcggcggtctgacgctgaccggcgatgtacgcacgctgcatcgctccggttccggctggcgcgtcgaaaccaacgagggcggcgtcgatagcgcgaatgtgatcgttgcgcttgggccctgggcgcccgatctgctggagccgctcggcatccgcctgccgatgaaattcaagcgcggctatcaccagcatttcaaggcggagggcaatgcgtcgctggcgcggcccgttgtcgatgtcgccaacggctatttgatcacgccgatggagcagggcattcgcctgacgacgggcgccgaattcgccgcgcgtgatgcggcaccaacgcctgtgcaattcgaccgcttgatgccggcggcgcgcggcctgtttccgctcggcgagcgcgccgacgacaagacctggctcggcgcgcggccgtgcttcccggactcgcgtccagtaatcggcaaggcgccgggacagagcggcctatggctcgcgatcggccacgctcattgggggctgacgcttgggccgccgaccggacggctgatcgccgatatgattgaaggcaagacgcccttcgtcgatccgaagccttacgcggcagagcgtttcctgtag

SEQ ID NO: 510 - protein, 414 aa, Unknown
  Obtained from environmental sample
  DOMAIN (5)...(395): FAD dependent oxidoreductase
  SITE (287)...(290): N-glycosylation site. Prosite id = PS00001
MARTDAIVMGAGIVGTSIALHLVKRGLSVALIDRAGIGEQTSYGNSGVIEGSTILPPAFPPGLSGLLRAAFKRGSDANYHFGFLPQVAPWLWAFRAASRPDRLAETARLNRPLFAAAIPEHEALMLESGATKYLRKTGWLKLYRNEASFNALQAEFELAKEFGLPLEALDAEGVQALEPSLRPVFARGVFWPKAASLSNPLAVTRAYAKRFSDLGGLTLTGDVRTLHRSGSGWRVETNEGGVDSANVIVALGPWAPDLLEPLGIRLPMKFKRGYHQHFKAEGNASLARPVVDVANGYLITPMEQGIRLTTGAEFAARDAAPTPVQFDRLMPAARGLFPLGERADDKTWLGARPCFPDSRPVIGKAPGQSGLWLAIGHAHWGLTLGPPTGRLIADMIEGKTPFVDPKPYAAERFL

SEQ ID NO: 511 - DNA, 1266 bp, Unknown
  Obtained from environmental sample
atgactgaagcttccagaacttcccgccagaccgaagtgatcgtgctcggcgccggcatcgttggcgtttccacggcactggccctgcaacagcgcggccatgccgtgtgcctgatcgaccgcagcgcgccgggccgcgagacttcgtatggcaatgccggcatcatccagcgcgaagcggtccagccctacgcatttccgcgcgcctggcaggcgatcctgcgcgtggcggcccggcgcggcaacgacgtgcactaccacctgcgtgcgttgccgtcgctggtgccgttgctggcgcgctactggcacgcatcggcgcccgagcgctatgtggcgacggtcagcgcctatgcggcactgatccgacactgtatcgacgagcacgcaccgctgatcgagcgcgcgggcgcacaggacctgatccgcaagtctggctggctggaggcttaccggacgccggccgcattcgaggcggcggtgaaggaggcgaacaccgtcgcggcggcgcaccagttgcgtcacgcaatcctggacagcgcggcgctggccgccgcggagccggtgctgcaacgtccgatggccggcgcggtgcactggcaggacccgtggaccgtcagcgatcctggcgagttggtggcccgctatgcggcgctgttcgagcgggaaggcggggtgttgctgcaaggcgatgccgatacgcttcgccaggcgggtagtggctggacggtgcgcacgcgtgacggtgccgttgacgccgaacatgccgtgatcgcactgggcccgtgggcggcggggctgacgcgccggcttgaataccgcctgccgctgttcgtcaagcgaggctaccatcgccactaccaggtcgatgcgatgccggccatgccgctgctcgatgccgagaacggcatcctgctggcgccgatgcgccagggcctgcggctgacgacgggcgccgaattcgcgcatcacgaggccccgcccacgccggtgcagtcgatgcgcgccgaaatgctcgccagcgatctggtgcggctgggcaagccggtggaagcgcagccgtggatgggggcgcggccctgcatcgccgacatgcgccccgtggtgggccaggcgccgcaccacgctaacctgtggttccatttcgggcacggccaccaaggcctgacgctggggcccgccacggcacggctgctggccgaactattcgatcgcgaagcgccgtacgtcgaccccgcgccgtatgacccccgccgcttcggccgctaa

SEQ ID NO: 512 - protein, 421 aa, Unknown
  Obtained from environmental sample
  SIGNAL (1)...(28)
  DOMAIN (12)...(401): FAD dependent oxidoreductase
MTEASRTSRQTEVIVLGAGIVGVSTALALQQRGHAVCLIDRSAPGRETSYGNAGIIQREAVQPYAFPRAWQAILRVAARRGNDVHYHLRALPSLVPLLARYWHASAPERYVATVSAYAALIRHCIDEHAPLIERAGAQDLIRKSGWLEAYRTPAAFEAAVKEANTVAAAHQLRHAILDSAALAAAEPVLQRPMAGAVHWQDPWTVSDPGELVARYAALFEREGGVLLQGDADTLRQAGSGWTVRTRDGAVDAEHAVIALGPWAAGLTRRLEYRLPLFVKRGYHRHYQVDAMPAMPLLDAENGILLAPMRQGLRLTTGAEFAHHEAPPTPVQSMRAEMLASDLVRLGKPVEAQPWMGARPCIADMRPVVGQAPHHANLWFHFGHGHQGLTLGPATARLLAELFDREAPYVDPAPYDPRRFGR

SEQ ID NO: 513 - DNA, 1266 bp, Unknown
  Obtained from environmental sample
atgaaagtcatcgtcttgggagcaggcatcatcggtaccgcatccgcctggtatctgcagcaggccgggcacgaagtgcaggtgatcgaacgcgccgccggtgctgcgctggaaaccagtttcgccaatggctgccagatttccgtttcccatgccgaaccctgggctaacccgtcggccccgctcaaggtcttgcaatggctggggcaggaagatgcgccgctgctgtatcgcttccgccccgaatggctgcaatggaaatgggcgctgtccttcctgcgcgaatgcacgccggcgcgcaccgctgccaatatccgccagatcgtcgcgctggccgaatacagccgtcaatcgctggtggcgctgcgccaggaaagcgggattgcctacaacgagctgacacgcggcatcctgcacttttacaccgaacaaaaggaattcgacaactcgctgccgatggccaaactgatgcgcgacctgggttgcccgcgcgaaagcatcagcgccgcgcaggtggtgcagctggaaccggcgctggctggcatccgcgacaagatcgttggcggcgactttaccgccaccgacgaatcgggcgatgtgtatcaattcaccagtggtctggcggccagggccgccgccgccggtgtcgatttccagtatcagacccagatcacgcgcctgctggtggaaggcaccggtgccgccgccaaggtgacggcggtcgaagtgatcgggccggatggccgccatcgcctgctgcaggcggatgccttcgtggtggcgctgggcagttattcgcaggcgctgctggccccgcatggcatcgacctgatgatttaccccggcaagggctattcggcgacctaccgcgtcaccgatgccgacgctgcgcccaccgtctcgctgaccgatgatggctacaaaatcgtcatctcacgcctgggcgaccgcctgcgcgtggccggcacctgtgaattgaacggttttggacgcgaactgaacccgacccgctgcgccgcgctgacgcgccgcacgcgcgagctgttcccgaccgcctgcgactatgacaatccggtgtactggaccggcctgcgcccgctgacaccatcgaatgtgccctatgtcggcaagagtaaaatcggcaatctgttcttgaacaccgggcacggcacattgggctggaccatgggctgcggctcgggccgggcactggccgacatcatcagccagcgcgtgccagaagttgattttaccttctcgtgccga

SEQ ID NO: 514 - protein, 422 aa, Unknown
  Obtained from environmental sample
  DOMAIN (2)...(407): FAD dependent oxidoreductase
MKVIVLGAGIIGTASAWYLQQAGHEVQVIERAAGAALETSFANGCQISVSHAEPWANPSAPLKVLQWLGQEDAPLLYRFRPEWLQWKWALSFLRECTPARTAANIRQIVALAEYSRQSLVALRQESGIAYNELTRGILHFYTEQKEFDNSLPMAKLMRDLGCPRESISAAQVVQLEPALAGIRDKIVGGDFTATDESGDVYQFTSGLAARAAAAGVDFQYQTQITRLLVEGTGAAAKVTAVEVIGPDGRHRLLQADAFVVALGSYSQALLAPHGIDLMIYPGKGYSATYRVTDADAAPTVSLTDDGYKIVISRLGDRLRVAGTCELNGFGRELNPTRCAALTRRTRELFPTACDYDNPVYWTGLRPLTPSNVPYVGKSKIGNLFLNTGHGTLGWTMGCGSGRALADIISQRVPEVDFTFSCR

SEQ ID NO: 515 - DNA, 1242 bp, Unknown
  Obtained from environmental sample
atgcagtctattgcagtcatcggcggtggaatcaccggcgtcacttccgcttatgcccttgctaagcgtggttatcaagttaccctttttgaaaagcagcgctatgcagcgatggaaacctcttttgccaatggtggtcagctttcggcctctaatgcagaagtttggacctgctggtcgactattctcaaaggattaaagtggatgctaaaaaacgatgcgccgctgctcgtaaatcctaagccatcttggcataagttcagttggtttgctgaatttatcgcttctatacctcagtatgaaaacaatacgaccgagacagcgcgtatggcgattgccgcgcgtgagttattgtttggctgggctaaagaagaaaatatcgatttcgatcatgtcgagaaaggaatattgcatatttatcgagataaagctggctttgagcatgctcaaaaagtttctcaattgctagctaaaggtggtttggtgcgcgaaacgctttctccaagtgacattcagcgaatcgagcctacgctaaaagggagttactacggtggctttttaacacccagtgatactaccggtgatatccataaatacacccaaggtttagccagagcctgtgagcgtttgggtgttaactgtctgtatgagcaagaagtgttggaagttaaggctgatgatcgtgaagctagggtaattgttaattcagtagaaggctcgattagccatcaattcgatgcggttgtggtatccgctggtgtggccagtcggaaactagcggcatcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtaccgcagaatttaacggctacaacaaagatatcagggctgatcgtattaagcctttggtggactgggtgaatcaatgcttcccagatgtaaacacacgaagcgtggttccttgggcaggacttcgtcctatgatgcctaatatgatgccaaaagtgggtaagggtaaattacccaccgtgttctacaataccggtcatggccatttgggttggacgttaagtgcggtgacggctgatatgttagcggatgtgatcgatcaggctagcacctcggcacaatttgttcccgcttga

SEQ ID NO: 516 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTILKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLARACERLGVNCLYEQEVLEVKADDREARVIVNSVEGSISHQFDAVVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 517 - DNA, 1239 bp, Unknown
  Obtained from environmental sample
ttgaaaagtgtaattatcattggaggcggaattatcggattgtgttctgcatattacttggcaaaagaaggcgcccaagtaacagtaattgataaatctgatatggcggatggctgttcttatggaaatgcaggaatgattgttcccagccacattattccaatggcgcaacccggcgtaattcatcaaggaattaaatggatgtttaatgccaaaagtccattttacataaaaccggcttttagtctggatttgctagcctggctgattcaattttacaaaaattccaatcagaatcatgttgataaatcaatggttcctttgcgaaatctttcattcttcagcaaagaattgtatcaggaatttgcgcaatcggccaatgaatttgggtatcaggaaaaagggcttttgatgctctacaatactgaaaaagttggagaagaagaaatcaaaataggaaaaattgcagaagaattggggatagaagtcgattttttaaatcagatggaagttaaggaactggaaaaaaatattgctgtaaaagcgttaggtgccgtccattacaaatctgatgcgcatttgtcgccaaatcattttattgcctttttaaaatccgaattaaatcagatggacgtgaagttgatttccaattactccttaatcgattttaatgtttctgaaggaaaaatatcagaattattgaccaatcagggaaattttaaggcagatgaatttgtgatttccgctggttcttggagtgtggaagttgccaaaaaattgggagtaaaattgcatatattgcctggcaaaggatatagttttaatgtggaaaatcttttggaaaaaccaacaattccgtctattttatgtgaaggaaaagttgctgtaacgcctatgggcgaaagggtgcgatttggcggaactttggaaatcaccaacaataatgatactaaaatcaatattaaaagactgcagggaattgttgaaaaagtaaatcaattttatccacatatcaaagttggacttcctgataaagaaaaagtatggcatggttttaggccttgcacgccaaccggattgccaattattgagaaatccaataaaattaaaaatttgaccattgcaacaggccatgcgatgatgggtttgagtttggcgcctgcatctggcaaactggttagtgaattgattatgggtaaaaaaacatcggtggatattgccgaatttaggagttgttaa

SEQ ID NO: 518 - protein, 412 aa, Unknown
  Obtained from environmental sample
  SIGNAL (1)...(21)
  DOMAIN (3)...(396): FAD dependent oxidoreductase
  SITE (111)...(114): N-glycosylation site. Prosite id = PS00001
  SITE (220)...(223): N-glycosylation site. Prosite id = PS00001
  SITE (227)...(230): N-glycosylation site. Prosite id = PS00001
  SITE (319)...(322): N-glycosylation site. Prosite id = PS00001
  SITE (376)...(379): N-glycosylation site. Prosite id = PS00001
MKSVIIIGGGIIGLCSAYYLAKEGAQVTVIDKSDMADGCSYGNAGMIVPSHIIPMAQPGVIHQGIKWMFNAKSPFYIKPAFSLDLLAWLIQFYKNSNQNHVDKSMVPLRNLSFFSKELYQEFAQSANEFGYQEKGLLMLYNTEKVGEEEIKIGKIAEELGIEVDFLNQMEVKELEKNIAVKALGAVHYKSDAHLSPNHFIAFLKSELNQMDVKLISNYSLIDFNVSEGKISELLTNQGNFKADEFVISAGSWSVEVAKKLGVKLHILPGKGYSFNVENLLEKPTIPSILCEGKVAVTPMGERVRFGGTLEITNNNDTKINIKRLQGIVEKVNQFYPHIKVGLPDKEKVWHGFRPCTPTGLPIIEKSNKIKNLTIATGHAMMGLSLAPASGKLVSELIMGKKTSVDIAEFRSC

SEQ ID NO: 519 - DNA, 1251 bp, Unknown
  Obtained from environmental sample
atgcggatcgttatcattggaggaggcatcattggtttaagcagcgcttattatttgcaggcaggcggacatgaagtaactgtcatcgataaaacggatatgagcagtaactgctcttatggcaatgcgggatatgtttgtcccagtcattttacaccgcttgccacaccgggtattgtaaagcaagggctcaaatggatgtggaattctaaaagtcctttttatgtgcaaccgaggctaagtcgcagtttgatcaactggggcatgcaattcatgaaagccgcaacccaacagcacgtggaagactcagccataccgcttagggatattgcgatcctgagtaaaaaaatgtatgaagaatggacagcattaccgcagttcaacttcgcttatgagcacaaaggattgttagagattttccaaacgccggaaggtgcagaacatgccaaacacgtagtagagaaagcccgcgaactgggattgaccgatactgccttgctggattacgatgcattgcaggcgatggaaccccagacaaggatcaacgcgcagggcgctgttttctttcgttgtgatgcgcatctttatcccaacaaattgatgcagcaactgatagccgatttgaaacaaaaaggcgtgcgcatacaaacaaatgaagaagtgattcgttttgaaaatgccaatggaaatatcactcaactaattacaaccaatggcgcttaccatgcagatacggttgtgatagccggcggctcctggagccgtgaactggctgccaaaatgaatgtcagtataccattggtgcccggcaggggatattcggttaccctggaagattcaccttaccggctcaactatccggccatattggtggaaggcagggtggctatgacgccgatggatggcaacaagctgcgcatgggcggaaccatggaaattacttccacacaaacaccccctcgcctcaaaagggtgcagggcattctggatgcagtgaaaaagttttaccctgaattcaatgtgccaatgcctgctgccgataaaatatggtatggctaccggccttgctcggcggatgggttgccctacctggggcgcacccggcaatggaagaatgtggtgttggctacggggcatgccatgttgggactgagtttgggcgcaggaacgggaaaactggtgagtgaagttgtggatgagcgggaaacgagcatggacatccgcccattcaaccccgaccgtttttcctga

SEQ ID NO: 520 - protein, 416 aa, Unknown
  Obtained from environmental sample
  DOMAIN (2)...(397): FAD dependent oxidoreductase
  SITE (37)...(40): N-glycosylation site. Prosite id = PS00001
  SITE (233)...(236): N-glycosylation site. Prosite id = PS00001
  SITE (266)...(269): N-glycosylation site. Prosite id = PS00001
MRIVIIGGGIIGLSSAYYLQAGGHEVTVIDKTDMSSNCSYGNAGYVCPSHFTPLATPGIVKQGLKWMWNSKSPFYVQPRLSRSLINWGMQFMKAATQQHVEDSAIPLRDIAILSKKMYEEWTALPQFNFAYEHKGLLEIFQTPEGAEHAKHVVEKARELGLTDTALLDYDALQAMEPQTRINAQGAVFFRCDAHLYPNKLMQQLIADLKQKGVRIQTNEEVIRFENANGNITQLITTNGAYHADTVVIAGGSWSRELAAKMNVSIPLVPGRGYSVTLEDSPYRLNYPAILVEGRVAMTPMDGNKLRMGGTMEITSTQTPPRLKRVQGILDAVKKFYPEFNVPMPAADKIWYGYRPCSADGLPYLGRTRQWKNVVLATGHAMLGLSLGAGTGKLVSEVVDERETSMDIRPFNPDRFS

SEQ ID NO: 521 - DNA, 1254 bp, Rhodococcus erythropolis DSMZ 44522
atgggaactcgtcagagccccgatcgtgtggtcgtggtcggtgcgggtgttgtcggattgtcgacggcctggttcttgcaggaacgtggagtcgaagtcaccgtcgtcgatcgcgacggcgtcgcagccgacgcgagctggggcaacgccggttggcttgcccccgcattgacgcttccgctgcccgaacccgcagtgctccaatacggcttgcgcgcgatgctcagcccgtcgtccccggtgtacgtgccactgaccaccgatctgaagctgattcggttcctggtcgggttcgcgcgccactgcacgccgtcgaagtggcaggaagcgatgtcggtctacaccgaggtcaaccgaacagccttgggcgcgtacgacgaactcgccgacggtggcgtcaaagagctgacgcgcctggccgatcctttcctcgccgcgtttgcgtccgagaaggaccgacagaccttggtggacgagttccaccacgtcgaagctgccggcggagaagtcgacttcgacctcctcgactacgacgccattcattcgctcgagccttcactcggtcagggtgtgaaagccggtttgcgtctgcgcaatcagcgtttcatcgatcccccgttgttcgtgaactcgttggcggacgcggttcgtgaacgtggtggagaaatcgtcagcggtttcgacgtcacgcagatcgacgatcgggtcggcggagtcactgttcgcagtgcacacggtgattcacgcgacggcgacgccgtggtcatctcgagcggtgcccgcttgaacaagctcgcagcaccgttcggtgtgcgcaaactggtgcaggccggacgcggatacagcttcagtgtcaagcccgagcacctccccaagaaccctgtgtatttccccacccagcgcgtcgcatgcactccgttgcacgatcgcttccgagtggccggaatgatggaattccgcagccctgacgcgccgctggatccgcgccgcgtgcaggcgatcatcgatgcggccaagccgatgctcagcggcatcgactggactgcgcgggaagaggaatgggtgggatcacggccgtgcactaccgacggcttgccgttgatcggagccacgcgctcgccgcgcgtgcacgtcgccggtggtcacgggatgtggggaatcgccctgggtccgttgaccggaaagatggtggccgactcgatgaccggcgctcagacgccgaccgtcatgcgccacttcgatccgctgcgctga

SEQ ID NO: 522 - protein, 417 aa, Rhodococcus erythropolis DSMZ 44522
  DOMAIN (9)...(400): FAD dependent oxidoreductase
  SITE (119)...(122): N-glycosylation site. Prosite id = PS00001
  SITE (352)...(360): Myb DNA-binding domain repeat signature 1. Prosite id = PS00037
MGTRQSPDRVVVVGAGVVGLSTAWFLQERGVEVTVVDRDGVAADASWGNAGWLAPALTLPLPEPAVLQYGLRAMLSPSSPVYVPLTTDLKLIRFLVGFARHCTPSKWQEAMSVYTEVNRTALGAYDELADGGVKELTRLADPFLAAFASEKDRQTLVDEFHHVEAAGGEVDFDLLDYDAIHSLEPSLGQGVKAGLRLRNQRFIDPPLFVNSLADAVRERGGEIVSGFDVTQIDDRVGGVTVRSAHGDSRDGDAVVISSGARLNKLAAPFGVRKLVQAGRGYSFSVKPEHLPKNPVYFPTQRVACTPLHDRFRVAGMMEFRSPDAPLDPRRVQAIIDAAKPMLSGIDWTAREEEWVGSRPCTTDGLPLIGATRSPRVHVAGGHGMWGIALGPLTGKMVADSMTGAQTPTVMRHFDPLR

SEQ ID NO: 523 - DNA, 1245 bp, Unknown
  Obtained from environmental sample
atgaaaaaaaagatactcgtaatcggcggcggtgccatcgggcttttttgtgcgtattatctcaggaagtccggccacagtgtaacggttgttgataaaagcgatttgtcagataattgttcttatggaaatgcaggcttgattgttcccagccatgttattcccatggcttctcccggaatggtctcatcggcattcaggtacatgcttaaccccaaagcgcctgtggcctttaagtttccaccctcgctgagttttttactatggtcttcccggtttctcatgaaagccaatcatctgcatgcctggaggtctgctgcaattttgaaggaaatcagtcttcttagtaaagggctctaccataacctcatgaaaaatggtgaaatagccgtggggttggaggaaagcgggttgctggttgtatgccgttcgcctaaagtgaaaacggaagaagctgaggctgccgaaatagccaatgaggtcggagtagctgctcgtgtgctttcatcggaagaagtgttgaaaatggaaccgtcgctgatgcaggaaatagccggtggcgtttattatcctggcgatgggcgcctgaatccgccacaattaatgaggagtttgctttctcaccttgaagatcaaggcgtttttttcatgagaaatgctactgtaaagaaactggagaaaaaaggtaacgcatataagtacgcggtggtcaacggcgagcagatagagtttgacgagttggtcattgcagcgggagtgtggagcaatgatctattgaaattggttggcaacaaggtgctgctgcagccgggaagagggtatagttttgatgttgaaaacacctgttccatccgaaaacccgcgttgctgattgatgccagggtatccgttacgccctttgtggacggtaccgtgcggtttggtgggggcatggagctgggatattttggcaaaagtattttcaggaaaagggttagtgaaatatgcaaatctgctaatcaatactatcccggactcgggaaattggaaatcagtaatttgcagatatggcaaggccaccgcccttgctcctttgatggcctgccatatattggcagggtgccgaagcatgacaatgtatatcttgccaccggccattccatgatgggcatcacactcgcccctgctaccgggaaattggtgagtgaactgattggtgaagtagagccttcgatggatgtatctgctttcagggtggacaggtag

SEQ ID NO: 524 - protein, 414 aa, Unknown
  Obtained from environmental sample
  DOMAIN (4)...(397): FAD dependent oxidoreductase
  SITE (39)...(42): N-glycosylation site. Prosite id = PS00001
  SITE (222)...(225): N-glycosylation site. Prosite id = PS00001
MKKKILVIGGGAIGLFCAYYLRKSGHSVTVVDKSDLSDNCSYGNAGLIVPSHVIPMASPGMVSSAFRYMLNPKAPVAFKFPPSLSFLLWSSRFLMKANHLHAWRSAAILKEISLLSKGLYHNLMKNGEIAVGLEESGLLVVCRSPKVKTEEAEAAEIANEVGVAARVLSSEEVLKMEPSLMQEIAGGVYYPGDGRLNPPQLMRSLLSHLEDQGVFFMRNATVKKLEKKGNAYKYAVVNGEQIEFDELVIAAGVWSNDLLKLVGNKVLLQPGRGYSFDVENTCSIRKPALLIDARVSVTPFVDGTVRFGGGMELGYFGKSIFRKRVSEICKSANQYYPGLGKLEISNLQIWQGHRPCSFDGLPYIGRVPKHDNVYLATGHSMMGITLAPATGKLVSELIGEVEPSMDVSAFRVDR

SEQ ID NO: 525 - DNA, 1242 bp, Unknown
  Obtained from environmental sample
atgcgcgcggatgtgatcgtgctcggggcgggcatcgtgggggtgtcggtcgcggtccatctacagaggcgcgggcgggcggtgattctcgtcgataagcgcgaacccggggaaggcacctctttcggcaataccgggctcatccagcgcgaggcggtctacccctacagcttcccgcgcagctggcgcgagatttttcggcacagccgcaaccgtgcaatcgatacccattatgactggaaggcgctgccgcgccttgcgcccttcctcgcacgctattggtggcactcgagtacgcggcggcacgccgaaatcgcgagaaaatatgcgcccctgatcgagcgctgcgtgccggagcatgtggcgcttgccgaggaggcgcaggcgtcggcgctcctccggccggggggctggatcaaggtcttccgttcgccggcggcgctcgaagagcgggcgcgcgacgccgagctttgggcgcgcgagttcgggatcgagtacaaggtgctcgagccgagcgcgcttgcggcgatggagccgcatctcgatccgacactcgtcggtgcgctgcatttcccggaaccggtcggcgtgaaggatccgcatgccttgacaatggcttacgtgcggctgttcgagcggctcggcggctcgcgggcgaaaggcgacgccgcaagcctcgaacccgcgccgggcggctggcgggttgcgacggaccgcggcccggtcgaggccggcgaggtggtggttgcgctcggcgcgtggtcggacgtcgtgacgaatcgtctcggctatcacctgccgctcggagtgaagcggggctaccacatgcattatcggccggccggcaacgccgtcctcaaccacaccatcctcgatgccgagaccggctatgccatggcccccatgaaccgcggcatccggctcaccaccggcgccgagttcgccgacaaggattcactcaagacgcccgtccagctcgatcgtgccgagcccctcgcccggaagctgttcccgcttggcgagcggctcgaccccgagccgtggatgggggtcaggccctgcacgcccgacatgctgccggtgatcggcccggcgccccggcacaagggcctgtggttcgccttcggccatgcccatcacgggctcacgctcgggcccgtgaccggccggctcctcgcggagatgatgaccggaagcgcgcccttcatcgatccgacgccttacagagcggatcgcttctag

SEQ ID NO: 526 - protein, 413 aa, Unknown
  Obtained from environmental sample
  DOMAIN (4)...(395): FAD dependent oxidoreductase
  SITE (291)...(294): N-glycosylation site. Prosite id = PS00001
MRADVIVLGAGIVGVSVAVHLQRRGRAVILVDKREPGEGTSFGNTGLIQREAVYPYSFPRSWREIFRHSRNRAIDTHYDWKALPRLAPFLARYWWHSSTRRHAEIARKYAPLIERCVPEHVALAEEAQASALLRPGGWIKVFRSPAALEERARDAELWAREFGIEYKVLEPSALAAMEPHLDPTLVGALHFPEPVGVKDPHALTMAYVRLFERLGGSRAKGDAASLEPAPGGWRVATDRGPVEAGEVVVALGAWSDVVTNRLGYHLPLGVKRGYHMHYRPAGNAVLNHTILDAETGYAMAPMNRGIRLTTGAEFADKDSLKTPVQLDRAEPLARKLFPLGERLDPEPWMGVRPCTPDMLPVIGPAPRHKGLWFAFGHAHHGLTLGPVTGRLLAEMMTGSAPFIDPTPYRADRF

SEQ ID NO: 527 - DNA, 1248 bp, Unknown
  Obtained from environmental sample
atgacaaaggacgcaatcgttctcggtgccggcatcgtcggcgtttcgacggcaattcatctgcagcgacgggggcgtcaggtcacccttgtcgacaagagggagcccggccgggaaacatcctttggcaatgccgggttgatccagcgcgaaggggtggtgccctacggctttccgcagcaattcggcctgttgctgcgctatgccctcaacaatcgcgtcgacgtgcactatcacctgcgcgccctgccctcgcaaatcgcgtttctcgcccgctattggtggaactccaataccaagcgccatgagatgatctcgcgcgcctatgcgccactgattgcgcattcggtcagcgagcacaacgaccttatccaagcctcacacgccgaagagctgatccggaagaacggttgggtggaattgttccgctcgaacgaaaagcgggatgccgagtttgccgaggccgagcgcctcaaccgggaattcggcattggttatgacgccttgagcagctcggaaattgcagcggccgagccgcacctcaaggacagctttgcaggagcgctgcgctggcgcgatccgtggtcggtcatggatccgcatgggctgacgtcggcttatcgccgctatttcgagagcatcggtggccgcgtcacgacaggtgatgctctctctcttgggatgtccggcaaatcctggaaaatggtcgcggcggaaggatcgatcgaggcagaagatgtcgtcgtggcgcttgggccgtgggccgatctggtcacgaaacggttcggctatgccttcccgcttggcgtcaagcgcggctaccatatgcactacgctgccgaagggaatgccgtcctcaacaatccgatgctggatgccgaacgcggctatctgctggccccgatgagccgcggcattcgactgacaaccggggccgaattcgcgcgccgcgatgcgccgaaaacaccggtgcagctggatcgtgcggaagcgcttgctcgctcggccttcccgcttggcgagcggcttgacccggaaccatggatgggcgcgcgcccctgcacgcccgacatgatgccgatcatcggcaaggcgccgcgtcatgaggggctatggttcgctttcggccatgcgcatcatggcctcacactcggaccggtgacgggccgtgttctcgccgagcttatcaccggcgagacgcccttcatcgatatctcggcttattcgcccggccgcttcgcgccctga

SEQ ID NO: 528 - protein, 415 aa, Unknown
  Obtained from environmental sample
  DOMAIN (4)...(395): FAD dependent oxidoreductase
MTKDAIVLGAGIVGVSTAIHLQRRGRQVTLVDKREPGRETSFGNAGLIQREGVVPYGFPQQFGLLLRYALNNRVDVHYHLRALPSQIAFLARYWWNSNTKRHEMISRAYAPLIAHSVSEHNDLIQASHAEELIRKNGWVELFRSNEKRDAEFAEAERLNREFGIGYDALSSSEIAAAEPHLKDSFAGALRWRDPWSVMDPHGLTSAYRRYFESIGGRVTTGDALSLGMSGKSWKMVAAEGSIEAEDVVVALGPWADLVTKRFGYAFPLGVKRGYHMHYAAEGNAVLNNPMLDAERGYLLAPMSRGIRLTTGAEFARRDAPKTPVQLDRAEALARSAFPLGERLDPEPWMGARPCTPDMMPIIGKAPRHEGLWFAFGHAHHGLTLGPVTGRVLAELITGETPFIDISAYSPGRFAP

SEQ ID NO: 529 - DNA, 1245 bp, Unknown
  Obtained from environmental sample
gtgccgcgaagcgacgttcttgtgctgggcgccggtatggtcggcgcctccgttgccgtgcatctcgccaagcggggcatgtcggcgacgctgatcgaccggcgagcggcgggggaggagacctcgttcggcaatgcgggcctgatcgaagcgagccggatgctgccgatcggattcccgcgcaacgtgcgtgagcttctacggcatgcaagcgggctctcaccgctcagccattttcactggagcgcattgccaggactggctccctttctgtggcggtactgggcggcgtcgcggccggagcggctcgatgcatcggcccgcatcttgcgtccgatgctggcttcggcgccggaggagcacacggcgctagcggcggaagcggggtcttctcgcctgatccgtagggcgggactcctcaagctgtttcgcacggaggagggctttcaggaaaccgccgccgatcgcgcctttgccgatgagttcggcgttccctacgaggtgctggaccgtgacgctgcgctcgcgcgggagccgcatttgcggcccgtattccgccgcgccttgttctggccgcacaccgacaattgctccgacccgggcgctttgaccaaatcttatgtcgcgctgttcgagaaactgggcggcgtattcgtgcgcggcgacgcgcgaagcttgcacccatttgcgggcggctggcgcgtcgagaccgacgccggcccggtcgacggccagcaagccgtgatcgcgctcggcccgtggagcatggatgtcgccggcaagttcggcgtccgtgtgccgttcgccgtcaagcgcggctatcacgtgcatcatgcgcctgtcggcaacgcaacacttagcgggggcgtgctcgattacgaaggcgggtatctgcttctgccgatggagcgcggcatccgcatcacgactggaatcgaattcgctcgccgcgatgcgccgccgacaccggtgcagattacccgtgtattgccggcggcgtgcgaattattcccgctcggcgaggcgcttgacgacaagccatggatggggtcgcggccggcgaccccggattccttgcccgttatcggccgcgcgccgggggggcaaaagagcctatggcttgcgttcggccattcgcatctcggctttacgctcgggccgccgaccggccggctgctgacggaaatgatcctgggcgaaaagcccttcgtcgatccggcgccgtttcgcgccgagcggttctag

SEQ ID NO: 530 - protein, 414 aa, Unknown
  Obtained from environmental sample
  DOMAIN (5)...(396): FAD dependent oxidoreductase
  SITE (199)...(202): N-glycosylation site. Prosite id = PS00001
  SITE (287)...(290): N-glycosylation site. Prosite id = PS00001
MPRSDVLVLGAGMVGASVAVHLAKRGMSATLIDRRAAGEETSFGNAGLIEASRMLPIGFPRNVRELLRHASGLSPLSHFHWSALPGLAPFLWRYWAASRPERLDASARILRPMLASAPEEHTALAAEAGSSRLIRRAGLLKLFRTEEGFQETAADRAFADEFGVPYEVLDRDAALAREPHLRPVFRRALFWPHTDNCSDPGALTKSYVALFEKLGGVFVRGDARSLHPFAGGWRVETDAGPVDGQQAVIALGPWSMDVAGKFGVRVPFAVKRGYHVHHAPVGNATLSGGVLDYEGGYLLLPMERGIRITTGIEFARRDAPPTPVQITRVLPAACELFPLGEALDDKPWMGSRPATPDSLPVIGRAPGGQKSLWLAFGHSHLGFTLGPPTGRLLTEMILGEKPFVDPAPFRAERF

SEQ ID NO: 531 - DNA, 1257 bp, Unknown
  Obtained from environmental sample
ttgaaagtcgtcatcctgggggccggtattaccggcataagttcggcgtggtttctgcgcgaagcagggttcgatgtgacggtaatagaccgtcagcccgaggccgcactggaaaccagcttcgccaatggcgggcagatttctgtctcgcaatccgagccctgggctaatcccgatgcacccatgaaggtactgaagtggctgtggcgggacgattcccccctgctcttccgcccgcgtcttgataccaagcaatgggcctggggcatgcgcttcctgcgcgaatgcctgcccggccggagcgagcagaacattgtccagctggttaacctggggctctatagccgcagcacgctcaaggcgctgcgtgagagcaccggcatccagtacgaccatctgagccgcggcatcctgcagatcttctttgaccagcaaagcttcgatgccgctgccgaggcctcggcgctgatgcgccgttacaactgctaccgcgaggccattccgcgcgagcgggcggtggagctggagcccgcgctggccgtactgggcagccgcctgaccggagccatctgggctgaggacgatgaatcgggcgacgctcgcctgtttacccagcagctggccaccctggccgccgagcgcggggtggagttccgctacaacacctgcatacgctcgctggaagctgagggcggcaagatcaccggcgtgcgcgcctgtagcagcgacggtagcgccgctaccatacagggtgatgcctacctgatctgcctgggcagctacagcccacagctgttggcgcccttgggcgtctacctgccggtctaccccaccaagggttactcggccaccatggtgaccgagggcttcgagggcgcgcccaccgtcagcatcaccgacgacgccatgaagatggtctacacccggctgggtgaccgcatccgcattgccggcacggccgaactcgacggttacaacactgaactgaatgaggtccgctgcgaggcgctgatccggcgctacttctcgctcttccctaattcggccgaccccaattcggtgcagtattggaccggcctgcggccttccacgccgtccaacgtgcccatcattggccgctcgcggcttagcaacctctacttcaacaccggccacggtaccttgggctggaccgaggggccaggttcgggccgggccattgccgagatcattgccggccgcaaaccggagctggagtttggctttgtgggaacttga

SEQ ID NO: 532 - protein, 418 aa, Unknown
  Obtained from environmental sample
  DOMAIN (2)...(403): FAD dependent oxidoreductase
MKVVILGAGITGISSAWFLREAGFDVTVIDRQPEAALETSFANGGQISVSQSEPWANPDAPMKVLKWLWRDDSPLLFRPRLDTKQWAWGMRFLRECLPGRSEQNIVQLVNLGLYSRSTLKALRESTGIQYDHLSRGILQIFFDQQSFDAAAEASALMRRYNCYREAIPRERAVELEPALAVLGSRLTGAIWAEDDESGDARLFTQQLATLAAERGVEFRYNTCIRSLEAEGGKITGVRACSSDGSAATIQGDAYLICLGSYSPQLLAPLGVYLPVYPTKGYSATMVTEGFEGAPTVSITDDAMKMVYTRLGDRIRIAGTAELDGYNTELNEVRCEALIRRYFSLFPNSADPNSVQYWTGLRPSTPSNVPIIGRSRLSNLYFNTGHGTLGWTEGPGSGRAIAEIIAGRKPELEFGFVGT

SEQ ID NO: 533 - DNA, 1269 bp, Unknown
  Obtained from environmental sample
atgagaaattccaaatcggtcgtcgtctgcggcggtggcatcgtgggcctgtgcaccgcctattacctcgcgcgcgagggctgcacggtgaccatcgtcgagcggcaggccggacccgcgcacaaccactgcgccaccggcagctcgggctacgtgtcgccgagccacgtcatcccgctcgcggctccgggcatggtctggaaggggctcaagtggatgttcaattcgcgcagcccgttctacatccagccgcggctcgacaccgagctgatgcgctggggctggctgttctggcgcgcgagccgccgccggcgggtggagcgggccgcgccggtgctgcgcgacctgtgcctgctgggacgccagctgttcgaggaactcgacgacctcaccgcggggcggtccgagttccgcaaggacggcctgctcaacctctgccgcacgccgcagggcctcgaccacgaggcgcacggcctggcccgcctcgccaacgagctgggcgtcgaggcgcgggtgctcgatgccgcccagaccgcggccctcgggctcggcgtgaagctggacatcgccggctcggtttattttcccatcgacgcgcacctcacgcctgcccgcttctgcgcggcgctcacggacctgctggaggagatgggcgtgcgcttccaatggagcacgacgatctacggctggcgctcggcggagaaccgcatcgccgcggcccacacgaccgcaggcgacctggtcgcggacgagttcgtcctcaccggcggctcctggtcggcgggcatgctggccggcctcggcctgcgcctgccgatgcaggcgggcaagggctacagcctcacgctgcccgcgccacgcttccacgtcacgaagcccttcatcctcaccgagcggcgcattgccgtgacgccgatgggcagcacgctgcgcttcggcggcacgatggaaatcgccgggcacaacgaccgcgtccgccccgagcgcgtggagcagatcaaggccggggtcatggccttcctgccggagttcaccgcggacgatttcgccggcatcaaaccgtggttcggctaccggccggtgacgcccgacggcctgccgtacatcgggcgcgtcggccgcgtgcgcaacctcacggccgcctgcgggcacgcgatgcttggcgtgacgctcgcgccgtcgaccgggcgcctggtcgcggaggtgatcgcgggtaagaagccgtcggtcgatctgacactgcttgatcccgatcgctacgcccgctga

SEQ ID NO: 534 - protein, 422 aa, Unknown
  Obtained from environmental sample
  SIGNAL (1)...(24)
  DOMAIN (6)...(402): FAD dependent oxidoreductase
  SITE (382)...(385): N-glycosylation site. Prosite id = PS00001
MRNSKSVVVCGGGIVGLCTAYYLAREGCTVTIVERQAGPAHNHCATGSSGYVSPSHVIPLAAPGMVWKGLKWMFNSRSPFYIQPRLDTELMRWGWLFWRASRRRRVERAAPVLRDLCLLGRQLFEELDDLTAGRSEFRKDGLLNLCRTPQGLDHEAHGLARLANELGVEARVLDAAQTAALGLGVKLDIAGSVYFPIDAHLTPARFCAALTDLLEEMGVRFQWSTTIYGWRSAENRIAAAHTTAGDLVADEFVLTGGSWSAGMLAGLGLRLPMQAGKGYSLTLPAPRFHVTKPFILTERRIAVTPMGSTLRFGGTMEIAGHNDRVRPERVEQIKAGVMAFLPEFTADDFAGIKPWFGYRPVTPDGLPYIGRVGRVRNLTAACGHAMLGVTLAPSTGRLVAEVIAGKKPSVDLTLLDPDRYAR

SEQ ID NO: 535 - DNA, 1581 bp, Unknown
  Obtained from environmental sample
atggaactgaaaggtctgtccctgatcggctttggcgaaggtgcgaagggcggtgcgccgctcaccgccagcaatgcgaccaccggcgagaagctcgccccggtcttccagtcggcctcggccgccgaggtggagcgcgccgcgcagctcgcggccgcggcgtttcccgtctttgccgccacgtccggcaaggttcgcgccggttttctccgcctggcggcgcagaaactcgaggccgccacggccgagctcgccgcccggggcaacatcgagacggccctgccgctggcgcgctgccagtcggaggtcggccgcaccatcggccagctgcgcctgttcgccacggtggcggagaagggcgactgggtggacgcgcgcatcgaaaccgcccagccggatcgcaagccggttccgaagcccgaccaccgttcgctctacgagccgctcggcccggtcgtcgtcttcggcgccagcaactttccctatgccttttccgtggccggcggcgacactgcctcggcgctcgccatcggctgcccggtgatcgtgaaggcgcactccggccacctcgggacctccgagctggtggggcgcctgctgggcgaggccgtgcgcgagtcgggcctgcccgagggcacgttctcgctgatcttcggttccggcgtcgagaccggccaggcgctggtgaagcacgccgcggtccaggccgtgggcttcaccggttcgcgcaaggcgggcgtcaacctgatgcaggtcgcggccgcgcggccgcagccgattccggtctatgccgagatgagcagcgtcaacccgctgttcgtcaccccggccgcgatcaaggcgcgttccgcggcgctggtcgacgggctcgcggcgtcgatcacgctcggcgtcgggcagttttgcacgaacccgggcctgctcatcgtgcaggcgggcgcggaaaccggcgcgttcctcgcggcgctcggcgccaagctggcggcgacgccgccggcctacatgctgaccaagggcatttgcaaagcctacgggcacggcatcgacgaacgcacgaaggccgcgggcgtgacaatcctgtcgcgggcgccggccggcgccgacggcacggccgccgcggtgctgttctccacgacggcggaaaatttcctgaagtcgccgggcctcgccgaggaaatcttcggccccagcacgctcgtcatcctgtgccgcgaccgcgcggaggtgctggcggtggccgcggtgggcgagggccagctgaccgcgaccatccacgcggagacgggcgaggatgtcgccgacctcgtgcggctgctcgcggtccgggcgggccgcgtgatcatgaacggttacccgacgggcgtggaagtcagccacgccatggtgcacggcgggccgttcccggcgaccgccgacggccgcagcacgtcggtcggcacgcgggcgctttaccgcttcgtgcgcgcggtgtgctaccagaatttcgccgacgccgccctgccgccgtcgctgcagaacgccaatcccctcggcctgcaccggctcgtcaacggcgagctgacgcaggacgcggtcaggtag

SEQ ID NO: 536 - protein, 526 aa, Unknown
  Obtained from environmental sample
  DOMAIN (11)...(490): Aldehyde dehydrogenase family
  SITE (25)...(28): N-glycosylation site. Prosite id = PS00001
MELKGLSLIGFGEGAKGGAPLTASNATTGEKLAPVFQSASAAEVERAAQLAAAAFPVFAATSGKVRAGFLRLAAQKLEAATAELAARGNIETALPLARCQSEVGRTIGQLRLFATVAEKGDWVDARIETAQPDRKPVPKPDHRSLYEPLGPVVVFGASNFPYAFSVAGGDTASALAIGCPVIVKAHSGHLGTSELVGRLLGEAVRESGLPEGTFSLIFGSGVETGQALVKHAAVQAVGFTGSRKAGVNLMQVAAARPQPIPVYAEMSSVNPLFVTPAAIKARSAALVDGLAASITLGVGQFCTNPGLLIVQAGAETGAFLAALGAKLAATPPAYMLTKGICKAYGHGIDERTKAAGVTILSRAPAGADGTAAAVLFSTTAENFLKSPGLAEEIFGPSTLVILCRDRAEVLAVAAVGEGQLTATIHAETGEDVADLVRLLAVRAGRVIMNGYPTGVEVSHAMVHGGPFPATADGRSTSVGTRALYRFVRAVCYQNFADAALPPSLQNANPLGLHRLVNGELTQDAVR

SEQ ID NO: 537 - DNA, 1260 bp, Unknown
  Obtained from environmental sample
atgaagccggacgtgattgtactcggtgccggaatggtcggcgtctcgacggctctccatctccagagccacggccatgacgtggttctggtcgaccgtcgtcctcccggcgaggaaacctcgtacggcaatgccggcgtcatccagcgcgaggccgtggaaccctatgcctttccccggtccgcgctgcagctcctgcgcttcgcgtgcaagaccggcccggaggtgaactatcattttcgcgccctgcccggactggtggggccgcttctgcggtactggtggtattccgcgcccgcccgctaccctgccatcgccgccgcgcatgcaaggctgatagagcaatgcctcagcgagcacgaggtgctgatcgggcaggccgcggcggacgacctggtgcggcgcgacggtttccgctttgtctatagatcggccaaggccctggagaccgacgcggcgcaagcccggcaactggcagaagaccatggccttgcctgcgatcttcttgacggcgatgccctggcgcgggccgagccggcgctgaaacggccgttggccggcgcgcttcactggcgcgatccctggacggtctgctcgccgggagagcttgtcgtccgctatgcggcgctgttccagcggaggggcgggaccgtgctgaccggcgatgcggcgagcctggcccggcagggaaataccggctgggcggtgatgacggaggacggcaagctggaggccgccaatgcggtgatcgcgcttggcccctggtcggtggagaccgcaaggcgcctcggataccgcctgcccctgttcgtcaaacgcggctatcatcgtcattaccggccccccgatggcgccgcgcggctggcactgccgacgctggatgcgcagaagggggtcgtgctggcgcccatggtacaggggctgcggatcaccaccggcgccgagttcgcccggctcgaagcgccatcgacgccggtgcagatcgacggtgccgcccgggcggcggccgagttgctggatatcggcgcaccggtcgagccggcaccgtggtgtggcgcgcggccctgcaccccggacatgctgccggtggtcggtgccgcgccgcgccacaacggcctgtggttccatttcggtcatgcccatcagggcttcacgctcggccccgtcaccggcaggctcattgcggagatgatcgggggcgaacgccccttcctcgacccgtcaccttatgccgtcacccgctttgccggcgggcgctga

SEQ ID NO: 538 - protein, 419 aa, Unknown
  Obtained from environmental sample
  DOMAIN (4)...(397): FAD dependent oxidoreductase
MKPDVIVLGAGMVGVSTALHLQSHGHDVVLVDRRPPGEETSYGNAGVIQREAVEPYAFPRSALQLLRFACKTGPEVNYHFRALPGLVGPLLRYWWYSAPARYPAIAAAHARLIEQCLSEHEVLIGQAAADDLVRRDGFRFVYRSAKALETDAAQARQLAEDHGLACDLLDGDALARAEPALKRPLAGALHWRDPWTVCSPGELVVRYAALFQRRGGTVLTGDAASLARQGNTGWAVMTEDGKLEAANAVIALGPWSVETARRLGYRLPLFVKRGYHRHYRPPDGAARLALPTLDAQKGVVLAPMVQGLRITTGAEFARLEAPSTPVQIDGAARAAAELLDIGAPVEPAPWCGARPCTPDMLPVVGAAPRHNGLWFHFGHAHQGFTLGPVTGRLIAEMIGGERPFLDPSPYAVTRFAGGR

SEQ ID NO: 539 - DNA, 1242 bp, Unknown
  Obtained from environmental sample
atggacttcgacgtaatcgttctgggcgcgggcatcgtcggcgtgtccgccgcgctgcacctgcaggatcgcggccgcaaggtcgccctcgtcgaccgcggtgcgcccggcgaaggcacgagcttcggcaacgcggggctgatcgagcgctcgtcggtcgaaccgtatccgttcccgcgcagcccgttcacgctgatgcgctacgcgctgaaccgctcgaccgatctctactggcacagcacgtcgctgccggcattcgcgccgtggctcgcgcgcttctggtgggaatcggcaccgatgcgtcatgcggcggcctcccgcgacatgctgccgctgatcgagcgctgcatcgtcgagcacgacgcgctgatcgcgcgcgccggcgccgcggagctgatccgtgcgagcggctggatggaagcgttccgcacgccggccgcgttcgaacgcgcggtcgccgatgccgggctcaccgcgcgccgccacgggctcggcatcacgccgctcgacgccgcggcgctgcgggcgcaggaaccgagcctcgcgccgggtttctgcggcgcgctgcactggctcgatccgaagagcgtcgtcgatccgtccgcgctcgtcaaaacctacgcgcacctcttcgtgcaaggcggcggcacgctgctcaacggcgacgccgcgagcctcgaagcgctctcgccgggctggcaggtcacgacgagcgacggcaggatcgccgcgccggccgtggtcgtcgcgctcggcccgtggtccgacacggtgttcggcaagttcggctacaagattccgctgcgcgagaaacgcggctatcacatgcactacgcgccatccgaacgcggcacgccgtcggcaccgatcgtcgatcgcgaatacggctacgtgatcgcgccgatgcggcgcggcctgcggctgacgaccggcgtggaaatcgcgcgccgcggcctgccgccgacgggcgtgcagctcgaacgtgcggaacgcgtcgcgcgcccggtgttcggcttcggcgaacggctcgacccgcagccgtggctcggcttccgcccatgcacgcccgacatgcggccggtgatcggccccgcgcccgcgcatcgcgggctgtggttcgccttcgggcacaaccatcacgggctgacgctcggccccgtgtccggtcggctgctcgccgagatgatgacgggcgacaccccgttcaccgatccgacgccttatcgcgcggatcgtttctga

SEQ ID NO: 540 - protein, 413 aa, Unknown
  Obtained from environmental sample
  DOMAIN (4)...(395): FAD dependent oxidoreductase
  SITE (72)...(75): N-glycosylation site. Prosite id = PS00001
MDFDVIVLGAGIVGVSAALHLQDRGRKVALVDRGAPGEGTSFGNAGLIERSSVEPYPFPRSPFTLMRYALNRSTDLYWHSTSLPAFAPWLARFWWESAPMRHAAASRDMLPLIERCIVEHDALIARAGAAELIRASGWMEAFRTPAAFERAVADAGLTARRHGLGITPLDAAALRAQEPSLAPGFCGALHWLDPKSVVDPSALVKTYAHLFVQGGGTLLNGDAASLEALSPGWQVTTSDGRIAAPAVVVALGPWSDTVFGKFGYKIPLREKRGYHMHYAPSERGTPSAPIVDREYGYVIAPMRRGLRLTTGVEIARRGLPPTGVQLERAERVARPVFGFGERLDPQPWLGFRPCTPDMRPVIGPAPAHRGLWFAFGHNHHGLTLGPVSGRLLAEMMTGDTPFTDPTPYRADRF

SEQ ID NO: 541 - DNA, 1266 bp, Unknown
  Obtained from environmental sample
atgcaacacgagatgcgcgtgaacgatgtcatggtttttggtgccggcgtatccggtctggcgaccgcgatcgcgttgcagaacgatggtcgtgacgtctgcgtcatcgatgccggccgcatcggcgctggtgcttcccacggcaactgcgggacgctgacgcccagccacgcgccgccactggcggcacccggcacgatctcccgggcgctgcgctggatgctgacgcccgacgcgccgctgtacatcccgccgcgtttcgatcccgcgctgtggcgctggctgctcggtttcgcgatgcgctgcaaccagcgcgactggatcgccagcgcgcgcgcgaagtcggcgctgctcaacgattcgcgccagcgcatcgccgactgggtgcgcgaccatgacttgcaatgcgaattcgccgaagacggggaggattacgtgttccgcgatccgcgcgcgctggaacacgagttgcgcgaacttccgttgctgcgcgagctcggcgtcgaagcggacgtcatcgacggcgccgcgtacgaagcgcaggaaccaacgctgaaaccgggcgtggcgggcgcgatccgcttcgccggcgatgccgcgttgcggccggaccgttacgtcgcggaactggcgcgcgtggtgcgcgggcgtggcggccgcatcgtcgaacactgcgcgctgcaatcgctccgcgtcgatgcgaatggcgtggaagcgacgacctcgcaaggcgtaatgcgcgcgcgcgatgcggtggtcgcctgcggtgcatggtcgccgacgctcgcccgcgccatcggcctgccctggctgcgcaaggcgatccagccgggcaagggctattcgatgacctacgacgcgcccgtgctggtgccgaaacgcccgctggtgctgcgcgaggtgtcggtatgcgtcaccgcgtggggcagcggcttccgcctcggcagcacgatggaattctccggctacgacgccacgctcaacgagcgccgcctcggcgcgctggaacgcggcgcgcgcgaatacctgcaccatccggtcggccccggattgcgcgagcgctggtgcggctggcggccaatgagccgcgacgacatcccgttgatcggccgtgcaccgggccatcgccatctctggctggcgactggccacggcatgatgggcgtgggcatgagcgccggcaccgggcagctgctcgccgacctggtcgcgggccgcgcgcccgcgatcgatccggcgccgttcgatcccgcgcgattcgcatga

SEQ ID NO: 542 - protein, 421 aa, Unknown
  Obtained from environmental sample
  DOMAIN (9)...(402): FAD dependent oxidoreductase
  SITE (120)...(123): N-glycosylation site. Prosite id = PS00001
MQHEMRVNDVMVFGAGVSGLATAIALQNDGRDVCVIDAGRIGAGASHGNCGTLTPSHAPPLAAPGTISRALRWMLTPDAPLYIPPRFDPALWRWLLGFAMRCNQRDWIASARAKSALLNDSRQRIADWVRDHDLQCEFAEDGEDYVFRDPRALEHELRELPLLRELGVEADVIDGAAYEAQEPTLKPGVAGAIRFAGDAALRPDRYVAELARVVRGRGGRIVEHCALQSLRVDANGVEATTSQGVMRARDAVVACGAWSPTLARAIGLPWLRKAIQPGKGYSMTYDAPVLVPKRPLVLREVSVCVTAWGSGFRLGSTMEFSGYDATLNERRLGALERGAREYLHHPVGPGLRERWCGWRPMSRDDIPLIGRAPGHRHLWLATGHGMMGVGMSAGTGQLLADLVAGRAPAIDPAPFDPARFA

SEQ ID NO: 543 - DNA, 1248 bp, Unknown
  Obtained from environmental sample
atgtcagatatattaataataggcgctggaatagtcgggcttagctctgcctactatttgcgaaagcagggacatcatgtagttgtccttgataagagtgatattgaggataactgttcatttggaaatgccggaatgattgtcccaagtcattttgtgccgcttgccgctcctggtatggttcagcagggcatcaggtggatgttcaatagtaaaagcccgttttatgttaagccttctttaaacaaaaatcttgttagctggggcttaaaatttattaaacatgccaatgatagccatgttgccagtgctgcggagcccttaagagatctttcgcttttgagcaaaagattgtaccaggatctggctaaggagcccggctttgactttggtcttgttaataacggaatcctggctttttataaaacggagaaggcggcggaagaggaagcgcatctcgccagcagaggaagagcgctgggcttagatatggtagttttaagcccggctgaatgtaaaactttgcagcccgggattgaacttgatgtgctgggagccgttcattataagtgtgattcccacctttatcctgcaaaattaatgcgggcactgatcagctttttagaaaataatggtgtcaagattgtacggaaccacgaagttaccgcgatagattctaagaatgggaaaattgattccgtaagaactggaggaaaagtatggaaggcagaccaatatatattggcaacaggatcatactctccggcgttggccaaactggtaaatgttaagttatccattatgccgggaaaaggatattcttttatggaagaaaataaggacaacaaacttactatccctgcgctgctatgtgaggctagagtggccataacgcctatgaatggtgaaatccgttatggcgggactatggagcttgcgaagattaacagtcacataaatatgaaaagagtgcagggcatagtagagtctgttccaaaatatatgaccaatttaactcccgctgtacctcaagccgacaaaatatggtatggattcagacctgcctctcccgatggtttaccttatatagggagaagtaaggagttagataatttattgatcgctactggccacgggatgatgggtttaggccttggtcccgctaccggattattggtgagccagctcgttgatggagccaaaactgaaatcgatataaaaccattttcaccgtcaagatttgattaa

SEQ ID NO: 544 - protein, 415 aa, Unknown
  Obtained from environmental sample
  DOMAIN (3)...(396): FAD dependent oxidoreductase
  SITE (38)...(41): N-glycosylation site. Prosite id = PS00001
  SITE (98)...(101): N-glycosylation site. Prosite id = PS00001
MSDILIIGAGIVGLSSAYYLRKQGHHVVVLDKSDIEDNCSFGNAGMIVPSHFVPLAAPGMVQQGIRWMFNSKSPFYVKPSLNKNLVSWGLKFIKHANDSHVASAAEPLRDLSLLSKRLYQDLAKEPGFDFGLVNNGILAFYKTEKAAEEEAHLASRGRALGLDMVVLSPAECKTLQPGIELDVLGAVHYKCDSHLYPAKLMRALISFLENNGVKIVRNHEVTAIDSKNGKIDSVRTGGKVWKADQYILATGSYSPALAKLVNVKLSIMPGKGYSFMEENKDNKLTIPALLCEARVAITPMNGEIRYGGTMELAKINSHINMKRVQGIVESVPKYMTNLTPAVPQADKIWYGFRPASPDGLPYIGRSKELDNLLIATGHGMMGLGLGPATGLLVSQLVDGAKTEIDIKPFSPSRFD

SEQ ID NO: 545 - DNA, 1296 bp, Unknown
  Obtained from environmental sample
atggcgcagaaggcaagcgcaaggatcgaaccccatggaagaagctcaatggcccgctgcgacgtgatcgtgctcggcgccggcattgtcggcgtctcaactgccctgcatctggcgcgccgcggcgtcgctgtggcgctggtcgaccgcgacaagccgggcgagggcacctcctacggcaatgccggggtgattggcggtgcgggcgtctatccaacggctttcccacgtgatttcggtacactgctgaaggtggcgctaaaactctcgccggccgccaattatcacctcgccgatttgccgcggctggcgccctggctgttcgcctatttccgcgcctcctcgccgcgcgaactcgaagccacggcccgcgcgctgcggccgctgatggcggtggcggttgccgagcacgagatactgatggccgagtcggatgcgctgggtttcctgcgcaaggacggctggatctcgatctatcgcagcgccggcggctttgccgacatggccccgcagctggcgctcggcgaggaacttggcgtgcgcgccgtaacgctcgatcccgacggcgcacaggcgctggagccgagcctttcgccggtgttccacaaggcgatccactggcccgacatcgccagcgtctccgatcctcttggcgtgaccgaggcctataccgcgcgcttccaggcgctcggcggtctcgtgctcaccggcgatgcccgcagcctgcaccgcagcggcgaaaactggcgcgtcgacaccgcggaaggaccggtcgatgcgccgcaggcggtgatcgcgctcggcccctggggcgccgatctgctcgaaccgctcggcgtgcagctgccgctcgcggtcaagcgcggttatcaccggcatttccgcggcgagggcaatgccgcgctcaagcggccaatcgtcgacccggaggtcggctatgcgctggcgccgatgcgccagggattgcggctcaccaccggcgctgagttcgcccgccgtgacgcgccgccgacgccggtgcagttcgaccggctgctgccggaggcgcgacggctgtttccgcttggcgagaccgccgatgcccgcacctggctcggcgcgcggccctgcctgcccgatatgcgcccggcgatcggcccggcgccgggccagcgcgggctgtggctcaatttcgcgcataaccatttcggcctgacgctcggccccgtctccggtcgcctgcttgccgatatgatgttcgacgacaccccgctctgcgatccggcacctttctcaccggcgcggtttggcacctga

SEQ ID NO: 546 - protein, 431 aa, Unknown
  Obtained from environmental sample
  DOMAIN (21)...(411): FAD dependent oxidoreductase
MAQKASARIEPHGRSSMARCDVIVLGAGIVGVSTALHLARRGVAVALVDRDKPGEGTSYGNAGVIGGAGVYPTAFPRDFGTLLKVALKLSPAANYHLADLPRLAPWLFAYFRASSPRELEATARALRPLMAVAVAEHEILMAESDALGFLRKDGWISIYRSAGGFADMAPQLALGEELGVRAVTLDPDGAQALEPSLSPVFHKAIHWPDIASVSDPLGVTEAYTARFQALGGLVLTGDARSLHRSGENWRVDTAEGPVDAPQAVIALGPWGADLLEPLGVQLPLAVKRGYHRHFRGEGNAALKRPIVDPEVGYALAPMRQGLRLTTGAEFARRDAPPTPVQFDRLLPEARRLFPLGETADARTWLGARPCLPDMRPAIGPAPGQRGLWLNFAHNHFGLTLGPVSGRLLADMMFDDTPLCDPAPFSPARFGT

SEQ ID NO: 547 - DNA, 1266 bp, Unknown
  Obtained from environmental sample
atgaccgacaaacgacgcgttgttgtctgcggcggcggtgtgatcgggctgtgctgcgccgacagcctcgcgcgcgaaggtcacgaggtgacggtgatcgaccgcggcgccgagggggccgacacgtgtgcgcacggcagcgcgggctacgtgtcgccgagtcacgtggtgccgctcgccgcgccgggtatggtggcgctcgggctcaagtggatgctcgatccgcgcgggccgtttcatgtgaggccacggttcgatgcgggctttctgcgctgggcgtggttgtttgcgcgctcgtgcagcgaagcgaacgtcgcgcgcggcgcgccggtgttgcgcgatctctgtctcgcgagccgagcgatgttcgcggagttcgcgcgagagtcgggcaacgtgttcgagtatgccgagcgcggactgctgatcctctgccgcacacaggagacgctcgatcacgagacacacggcctcgcgcggatcgccaacgaactcggagtcgaggcgcgcgtgctcgacgcgtccgccacggcgcgcaccgagcccggcgtgcggatgagtgtcgcaggatcgctgcaattccccatcgatgcgcacgtgacgccgcggctcttcatgccggcgctgctctcgcggctgaaggctcgaggtgtggcgttccgctggggcacggagatcaccggttgggtcgagggcgaagggcgcacgatccgagcggtgcgcacgagcggcggcgacgtcgcgggagacgagttcgtggtcgcgggcggcgcgtggtcgccgctgctgttgcgcgggctcggcgtgaggctgccgatggaggcgggcaagggctacagtctcacgattcccgagtcacccgtgcccgtatcggtgccgatgatcctcgcagaggcacgcgtggcggtgactccgatgggtcgcgcgttgcgcttcggcggcacgatggaattgaccggcatcaacaacacgatccggccggagcgcgtcgaccagatcaaggccgctgcgtgccagttctatccggattttcctgccgccgcgttcgacggcctcgagccgtggtcggggctgcgtccggtgtcgcccgatgggctgccctacatcgggcgattcgcgtcgaggcccaacctgattgcggcgggtggccacgcgatgctcgggctcacgctcgcgccagtgacgggcgcgctcgtggccgacgtggtcgcaagccgcacgccctcgatcgcgctcgagcatctgagcccggatcgattcggatga

SEQ ID NO: 548 - protein, 421 aa, Unknown
  Obtained from environmental sample
  SIGNAL (1)...(24)
  DOMAIN (6)...(402): FAD dependent oxidoreductase
  SITE (326)...(329): N-glycosylation site. Prosite id = PS00001
MTDKRRVVVCGGGVIGLCCADSLAREGHEVTVIDRGAEGADTCAHGSAGYVSPSHVVPLAAPGMVALGLKWMLDPRGPFHVRPRFDAGFLRWAWLFARSCSEANVARGAPVLRDLCLASRAMFAEFARESGNVFEYAERGLLILCRTQETLDHETHGLARIANELGVEARVLDASATARTEPGVRMSVAGSLQFPIDAHVTPRLFMPALLSRLKARGVAFRWGTEITGWVEGEGRTIRAVRTSGGDVAGDEFVVAGGAWSPLLLRGLGVRLPMEAGKGYSLTIPESPVPVSVPMILAEARVAVTPMGRALRFGGTMELTGINNTIRPERVDQIKAAACQFYPDFPAAAFDGLEPWSGLRPVSPDGLPYIGRFASRPNLIAAGGHAMLGLTLAPVTGALVADVVASRTPSIALEHLSPDRFG

SEQ ID NO: 549 - DNA, 1254 bp, Unknown
  Obtained from environmental sample
atgaaggtgatcgtcttgggtgccggcgtaatcggcatcagcagtgcgtggtatctcgcgaaacaggggcatgacgtcaccgtggtcgaccgtcagcctggcgctggactcgaaaccagcttcgccaatggcgcgcagatttcggtctcccaatctgagccgtgggcgtcgccgggcgcgccattcaaagtgatgaagtggctgatgcaggacgacgcgccactgctgtttcgtccaaaacttgaatggcatcagctgtcttggggcatgcgctttctggtcgagtgtctaccgtggcgcttccgtcgcaacatccgcgaaatggtgaatctcggcctgtacagccgccaggcactgcaggagttacgcgcagagaccggcatttcctacgaccagatcacgcgcgggattctgcagttctacaccgacaagggcgatttcctggcagcacaagaggcgtcgaaattgctaagccagtacggcatcgatcgcgcggtaaaaacagccgacgaggcgattgcaatcgagcctgcgcttaaccatatccgtgatcgcctcgctggtgcgacttacgcagaaaccgacgaatccggtgacgcgcataccttcacgcaaaacctcgctggactgtgcgcgctcaaaggtgtgagcttcgcctacggcgcgatggttgaggcgattgagaccgacactggacgcgtcagcggcgtacgcgttcgtcactccactggccacaccgaaacactgaccgccgatgcatacgtgtgcgcaatgggcagctacagctatctgatgatgaagccgatcggcatcaccttgccggtctacccggcgaagggctactcggcgaccatatccaccaagggttttgagggcgcacccaccgtcagcctcaccgatgaggcaatgaagatcgtcttttcgcgtctgggtgatcgcatgcgcatcgcgggaaccgccgagctcgatggctacagcaccaacctctcgatcatccgcaccgaagcactggtgcgccgcgcgcgcgagttgtttccgaacgcagccgattacgatcatccggtgtactggaccgggctgcgtcctgcgacgccgtcgaactgcccgctgattggcaagaccaagtaccccaacctgttcttgaatacgggccacggcacgcttggctggaccgaggggccgggctccggtcgtgcgctcgccgacatcgtttccggcaagacgccggaagtcgattaccagttcctgaaatag

SEQ ID NO: 550 - protein, 417 aa, Unknown
  Obtained from environmental sample
  DOMAIN (2)...(403): FAD dependent oxidoreductase
  SITE (333)...(336): N-glycosylation site. Prosite id = PS00001
MKVIVLGAGVIGISSAWYLAKQGHDVTVVDRQPGAGLETSFANGAQISVSQSEPWASPGAPFKVMKWLMQDDAPLLFRPKLEWHQLSWGMRFLVECLPWRFRRNIREMVNLGLYSRQALQELRAETGISYDQITRGILQFYTDKGDFLAAQEASKLLSQYGIDRAVKTADEAIAIEPALNHIRDRLAGATYAETDESGDAHTFTQNLAGLCALKGVSFAYGAMVEAIETDTGRVSGVRVRHSTGHTETLTADAYVCAMGSYSYLMMKPIGITLPVYPAKGYSATISTKGFEGAPTVSLTDEAMKIVFSRLGDRMRIAGTAELDGYSTNLSIIRTEALVRRARELFPNAADYDHPVYWTGLRPATPSNCPLIGKTKYPNLFLNTGHGTLGWTEGPGSGRALADIVSGKTPEVDYQFLK

SEQ ID NO: 551 - DNA, 3306 bp, Unknown
  Obtained from environmental sample
aaagaattcggcacgagagacgcagaacgcctcggcaaattggtcagcgaccctgccggcctcgcgttggccgtcggttttgtcgacgatgtcgcccgcccgcaagacactgccgtggccgccaaggcgctcgccaaactcggcacgaaggccggtgacgcatccttcctgtcgcctgcagaccgcgcactgttccgtctcggcgccttcgccgctcccatcctgcctgccgtagttgtgcctgccgcgcggatgcgcctcaagcagcttgtcggccacctcgttgctgacgcgggtgatggcctgggtaaacacctggcgcgcacccgcgaggaaggttacgcgctgaacgtcaacctgctcggcgaggccgtgcttggtgccgatgaggctgccgcccgcctgcagcgcaccatcgacctggtcaagcgccccgacgttgactacgtgtccatcaaggtgtcgtctgtcgccgcacaactcgtcacctgggatcttgagggctcaaagcagcgtgtcgtcgacgagttgctgccgctgtaccgtgccgcacgggatcacggggtgttcctcaacctcgacatggaggagtaccgggatctcgcgctgacctgtgccgtcttcaccgatattctcgctcgcgacgagttcaagactctggaggcgggcattgtcctgcaggcatacctgcccgacgctgtcggcgcactcgacgacctgaccgaatttgcgcaggcccgcgtcgatgctggtggtgcgcgcatcaagattcgtctcgtcaagggtgcgaacctcgcgatggagtccgtcgaggctgaactgcacgactggaacctcgccacctacccgaacaagcccgatgtagacgccaactacctgcgcttcctcgaccgtgcactcgaccccgcccgcacccgcgcggtgcgcctcggcgtcgcctcacacaacctcttccacgtcgcgctcgccgtgctcgtcgcccgtacgcgcggcgtcggcgaggcgatggatatcgaaatgctccagggcatggctcccgcgcaggctgccgccgttcgcgccgaagtcgccctagacggcgggcgtgtcgtcctgtacacccccgccgtgcgtgacgaagacttcgacgtggccatcagctacctggtgcgtcgcctcgaagaaaacgccgcctcgcagaacttcctccacgcccagttcgctggcggccagggcgccatcgcaggccaggaggccgctttccgtaccgccgtcgctgctgccgttccgttcgcgccagaggccatcgccccgcgccgcaccccgcgctcgcagtggccgaatattgccgacgagatcgccgccgatggggtgttccgcaactccatcgacaccgaccctgccgtagctgcgcaccgaaacggcgccgccatcattatcgaccgtgaacagtccgggtacaagcctgttcagacgctgatgacgacggacgctgagactatcgacgctgcgctcacccgatccgtcgccgttcagcaggtatgggcagccgtgcccgctgccgcccgcgccgaggcgcttcacgccatcggacgtcgtttggaggccgcccggttcgacctcgtcgctgccgaagttcacgaggctggcaagacggtcgcagaagcagacccggaggtgacggaggccatcgacttcgcccactactacgctggctccgcgctcaccctcgacggggtgacaggcgcgaacttcacacccgacggagtcacgctcgttaccccgccgtggaacttccccgtcgccattcctgcaggcggtgtgcttgcggcgctcgcggccgggtcatccgttatcgcgaaaccggcttcgccgaccccgcgctgtttcgaacttgtcattgaggccgttcacgctggtcttgacgatgcgtcggcgacgaccggcttaacccctgagcagaaccgcgacatcgtccagtttattcgcgtctccgagcggtcgcttggtaagcagttggtcacccatgatgcggtggcccgcgtcatcctcaccggctccatcgagacagcggaacttttcgcgtcgtggaagcccgagcgtcccgtgcttgcggaaacctccgggaaaaactccatcattgtcaccgcgtcctccgacatcgacctggccgtcgctgacgtgctgcggtccgccttcggacatgccgggcagaagtgctccgctgcttcgttggcgattctcgtcggctccgtcggcgacccgaagtctgcgacgggcgaacgcttccgccgtcaactcatcgacgccgtgaagtccctggccgttggcgcaccgaccacgctgtccactgtcatgggtccgctgaccgagcctgctggtgagaagttaacccgggcgctgaccacactcgagccgggggagacgtggctggtcaagcccgaacttcttgacgagcaggcggctgccgcaggcctcggtgaaaaccgcctgtggacgcctggcctgcgcgacggtgtcaagcccggttcatggttccacctcaccgaagcgtttggtccggtgctcggcctgatgacggcccgcacacttgaggaggctatcgagttacagaacgccaccgcgttcgggctcaccgccggcctgcactccctcgacgacgatgagatcgccctgtggaaggaccgcgtccaagccgggaacctctacatcaaccgccacatcaccggtgctatcgtccagcgtcaaagcttcggaggctggaaggcctcgtcggttggccccggcgcgaaggctggcggtccccactatgttgcgatgctcggccagtgggccgacgctgccgatgtcccctcgcgcgatactgactcggctgcgtggttggagtgggcgaaggccgatgacacccgcgtgtgggcgcagttgtcgaaggaggtcgacttgtctgggctcgtcagcgaggagaacaccttccggatgcgtcccatcgacgcgctgaccatccgcgttggtgacggcgcactgcccgtcgaggtggagcgtgtgcgcaacgccgcctggacggcaggtgttgagtccgtcgtgatcccagttcacgacatgacacacgaagtcttcgccgccgccgtcgcgtctggtgacatctcaggccgcatccgcgttatcggcgcagcgcctggcctacacgaggccgccgcgacggttctcggctcaacgacggtgctcgacgccccggttgtcgcctcgggtgcccgcgaactgctcaacgtgctccgtgaacaggccgtcagccgcaccaaccaccgttatggccacattaagcactga

SEQ ID NO: 552 - protein, 1101 aa, Unknown
  Obtained from environmental sample
  DOMAIN (60)...(403): Proline dehydrogenase
  DOMAIN (472)...(937): Aldehyde dehydrogenase family
  SITE (737)...(748): Aldehyde dehydrogenases cysteine active site. Prosite id = PS00070
  SITE (878)...(881): N-glycosylation site. Prosite id = PS00001
KEFGTRDAERLGKLVSDPAGLALAVGFVDDVARPQDTAVAAKALAKLGTKAGDASFLSPADRALFRLGAFAAPILPAVVVPAARMRLKQLVGHLVADAGDGLGKHLARTREEGYALNVNLLGEAVLGADEAAARLQRTIDLVKRPDVDYVSIKVSSVAAQLVTWDLEGSKQRVVDELLPLYRAARDHGVFLNLDMEEYRDLALTCAVFTDILARDEFKTLEAGIVLQAYLPDAVGALDDLTEFAQARVDAGGARIKIRLVKGANLAMESVEAELHDWNLATYPNKPDVDANYLRFLDRALDPARTRAVRLGVASHNLFHVALAVLVARTRGVGEAMDIEMLQGMAPAQAAAVRAEVALDGGRVVLYTPAVRDEDFDVAISYLVRRLEENAASQNFLHAQFAGGQGAIAGQEAAFRTAVAAAVPFAPEAIAPRRTPRSQWPNIADEIAADGVFRNSIDTDPAVAAHRNGAAIIIDREQSGYKPVQTLMTTDAETIDAALTRSVAVQQVWAAVPAAARAEALHAIGRRLEAARFDLVAAEVHEAGKTVAEADPEVTEAIDFAHYYAGSALTLDGVTGANFTPDGVTLVTPPWNFPVAIPAGGVLAALAAGSSVIAKPASPTPRCFELVIEAVHAGLDDASATTGLTPEQNRDIVQFIRVSERSLGKQLVTHDAVARVILTGSIETAELFASWKPERPVLAETSGKNSIIVTASSDIDLAVADVLRSAFGHAGQKCSAASLAILVGSVGDPKSATGERFRRQLIDAVKSLAVGAPTTLSTVMGPLTEPAGEKLTRALTTLEPGETWLVKPELLDEQAAAAGLGENRLWTPGLRDGVKPGSWFHLTEAFGPVLGLMTARTLEEAIELQNATAFGLTAGLHSLDDDEIALWKDRVQAGNLYINRHITGAIVQRQSFGGWKASSVGPGAKAGGPHYVAMLGQWADAADVPSRDTDSAAWLEWAKADDTRVWAQLSKEVDLSGLVSEENTFRMRPIDALTIRVGDGALPVEVERVRNAAWTAGVESVVIPVHDMTHEVFAAAVASGDISGRIRVIGAAPGLHEAAATVLGSTTVLDAPVVASGARELLNVLREQAVSRTNHRYGHIKH

SEQ ID NO: 553 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgatcgcgttgttcagcaattcgtccgaaccccggctgcgcgagaacggcgcggccatccaatcgttgacggcgcacgcgcccgcaatgcatgaggacttaatgatcgaggccggcagggcggacctgttgcgcaagacaggctggctacagctttacgcgagcgatgccgcattcgccgccgatagcctgaagcggcgtatcgccgatgaggcaggatgcgactattcggtgctctacactgaagccgccaaggaactcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggaccttttgcgcccactcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgagacccattatcggacctgcaccgcgccatgacggattgtggctgaatttcggccatgcccatctcggctataccctgggcccggtctccgcgcggctactggccgagttgataaacggagattcgccgatcagcgatccggcgccattcgccgcgacgcgtttctga

SEQ ID NO: 554 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLIALFSNSSEPRLRENGAAIQSLTAHAPAMHEDLMIEAGRADLLRKTGWLQLYASDAAFAADSLKRRIADEAGCDYSVLYTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAATRF

SEQ ID NO: 555 - DNA, 1242 bp, Unknown
  Obtained from environmental sample
gtgccgcgaagcgacgttcttgtgctgggcgccggtatggtcggcgcctccgttgccgtgcatctcgccaagcggggcgtgtcggcgacgctgatcgaccggcgagcggcgggggaggagacctcgttcggcaatgcgggcctgatcgaagcgagccggatgctgccgatcggattcccgcgcaacgtgcgtgagcttctacggcatgcaagcgggctctcgccgctcagccattttcactggagcgcattgccaggactggctccctttctgtggcggtactgggcggcgtcgcggccggagcggctcgatgcatcggcccgcatcttgcgtccgatgctggcttcggcgccggaggagcacacggcgctagcggcggaagcggggtcttctcgcctgatccgcagggcggggctcctcaagctgtttcgcacggaggagggttttcaggaaaccgccgccgatcgcgcctttgccgatgagttcggcgttccctacgaggtgctggaccgtgacgcggtactcgcgcgggagccgcatttgcggtccgtattccgccgcgccttgttctggccgcacaccgacaattgctccgacccgggcgctttgaccaaatcttatgtcacgctgttcgagaaactgggcggcgtattcgtgcgcggcgacgcgcgaagcctgcatccatttgcgggtgggtggcgcgtcgagaccgacgccgggccggtcgacggccagcaagccgtgatcgcgctcggcccgtggagcatggatgtcgccggcaagttcggcgtccgtgtgccgttcgccgtcaagcgcggctatcacgtgcatcatgcccctgccggcaacgcaacacttagcggaggcgtgctcgattacgaaggcgggtatctgcttctgccgatggagcgcggcatccgcatcacgactggaatcgaattcgctcgccgcgatgcgccgccgacgccggtgcagattacccgtgtattgccggcggcgcacgaattattcccgctcggcgcggcgcttgacgacaagccatggatggggtcgcggccggcgaccccggattccttgcccgttatcggccgcgcgccggggcaaaagagcctatggcttgcgttcggccattcgcatctcggctttacgctcgggccgccgaccggccggctgctgacggaaatgatcctgggcgaaaagcccttcctcgatccggcaccgtttcgcgccgagcggttctag

SEQ ID NO: 556 - protein, 413 aa, Unknown
  Obtained from environmental sample
  DOMAIN (5)...(395): FAD dependent oxidoreductase
  SITE (199)...(202): N-glycosylation site. Prosite id = PS00001
  SITE (287)...(290): N-glycosylation site. Prosite id = PS00001
MPRSDVLVLGAGMVGASVAVHLAKRGVSATLIDRRAAGEETSFGNAGLIEASRMLPIGFPRNVRELLRHASGLSPLSHFHWSALPGLAPFLWRYWAASRPERLDASARILRPMLASAPEEHTALAAEAGSSRLIRRAGLLKLFRTEEGFQETAADRAFADEFGVPYEVLDRDAVLAREPHLRSVFRRALFWPHTDNCSDPGALTKSYVTLFEKLGGVFVRGDARSLHPFAGGWRVETDAGPVDGQQAVIALGPWSMDVAGKFGVRVPFAVKRGYHVHHAPAGNATLSGGVLDYEGGYLLLPMERGIRITTGIEFARRDAPPTPVQITRVLPAAHELFPLGAALDDKPWMGSRPATPDSLPVIGRAPGQKSLWLAFGHSHLGFTLGPPTGRLLTEMILGEKPFLDPAPFRAERF

SEQ ID NO: 557 - DNA, 1260 bp, Unknown
  Obtained from environmental sample
atgacctacgatgttattgttctcggtgctggaattgtcggcgtctcgacagcgattcatttgctgcggcgcggcaggtcggtgctgctgatcgacaagaatgagcctggccgcgaaacctcgttcggcaatgcaggcatcatccagcgcgaaggggtgcgcccgcacgcgttcccgcgcgacctcgcaatgcttatgcaggtcgggctgcacctctctactgcggcccgctatgatccgctggccctgccccggatcgcacctccgctgctgcggtattggtgggagtcctccccaagccactacaggaacatcgtcaagagctatgcgccgctgatcggactttgtatcgacgagcatgccgatctgatcgccgcgtcggacagcgagcatctggtggtccggaaaggctggctgcttggcttcaggaccgaggcgaagctaaagacggaagaagccaaggcacagcaggatttcgatctgttcggggtcaatcacaaactgctctcgggtgacgatgtggcaaccctcgagcccgatttccggatcaagctggccggtgccattcagtggacagatccatggacgatcaaggaccccggcgcgctggtgtcggcctatttcgagtatttcaagtcactgggcggtgcatttcatgcgggcgcggtaaagagcctccagtccacgaacgagggctggactgccgagactgaaaacggcccgctcaagggcaaggaagccgtcgtgacgctcggcccctgggcacccgaggtgcttgagcctctgggctatcgcctgccgcttttcgtcaagcgcgggtaccacatgcactatggaacagagggcggcgccaagctcaacaactggatcatcgatgcagaggtgggctacctccttgcgccgatggaacgcggcatacgcctgacaaccggagcggaatttgcattgcgcgatgccgctccgacgcccatccagatcggccgggcagaaacggcggcaaaacagctgttccccatgggcgcgcaactggacccgacgccgtggaagggtgcccgcccctgtacccccgacatgatgcccattatcggcccggcgcccaaacaccgcggcctctgggcggggattgggcacgcccatcacgggttcaccctgggaccggcaacggggcacctgctggcgcaggtcatgaccggggaaaagcccgttatcgatattgcaccctttgccatggaccggttcgcgggcagctacaggcgatag

SEQ ID NO: 558 - protein, 419 aa, Unknown
  Obtained from environmental sample
  DOMAIN (4)...(395): FAD dependent oxidoreductase
MTYDVIVLGAGIVGVSTAIHLLRRGRSVLLIDKNEPGRETSFGNAGIIQREGVRPHAFPRDLAMLMQVGLHLSTAARYDPLALPRIAPPLLRYWWESSPSHYRNIVKSYAPLIGLCIDEHADLIAASDSEHLVVRKGWLLGFRTEAKLKTEEAKAQQDFDLFGVNHKLLSGDDVATLEPDFRIKLAGAIQWTDPWTIKDPGALVSAYFEYFKSLGGAFHAGAVKSLQSTNEGWTAETENGPLKGKEAVVTLGPWAPEVLEPLGYRLPLFVKRGYHMHYGTEGGAKLNNWIIDAEVGYLLAPMERGIRLTTGAEFALRDAAPTPIQIGRAETAAKQLFPMGAQLDPTPWKGARPCTPDMMPIIGPAPKHRGLWAGIGHAHHGFTLGPATGHLLAQVMTGEKPVIDIAPFAMDRFAGSYRR

SEQ ID NO: 559 - DNA, 1260 bp, Unknown; identical to SEQ ID NO: 557
  Obtained from environmental sample

SEQ ID NO: 560 - protein, 419 aa, Unknown; identical to SEQ ID NO: 558
  Obtained from environmental sample
  DOMAIN (4)...(395): FAD dependent oxidoreductase

SEQ ID NO: 561 - DNA, 1230 bp, Unknown
  Obtained from environmental sample
gtggacccgcacgtagtcatcgccggttgcggatttggcggcctgttcgcagcacgcgcgctcgcgggccggccggtgcgcgtcacggtggtcgatcgcacgaaccaccatctgttccagcccctcctgtaccaggtggcgaccgccggcctgtcggcgcccgcggtggccgcgccgatccggcacatccttgccgggcagcgcaacgccactgtgatctacggcgacgcgaccggcatcgacccgggacaacgcgcgctgctgctggacggcggcgagcgcatcgcctacgaccggctcatcctcgccacgggcgccgacaacagctatttcggcaacgacgcctggcgcgagcacgcgcccagcctcaagacgctggaggacgcctacgagatccggcgccgcgtgctgctcgccttcgagcacgccgagcgcgagaccgacgccgcgaagcgcgccgcatggctcaccttcgtcgtgatcggcggcggcgccacgggcgtggagctcgccggcgcgttcgccgagatcgcgcgccacacgctgccgggcgagttccggcgcttcgacccgcgcaacgcgcgcgtggtgctggtcgaaggcatcgaccgcgtgctgccgtcctacccggacacgctctcggagaaggcgcgcaagcagctcgagcgcctgggcgtcaccgtgtggctgggcaagcgcgtgaccgcgatcgacgcggagggcgtgtcgctcgggccggatcgcctcgcggcgcgcaccgtgatctgggccgcgggcgtggccgcctcgccgctcggcaagagcctcggcgtgccgctcgaccgcgcggggcgcgtgatcgtgaacgaggacctgaccgtgccgggccacccggagatatccgtgatcggcgacctggccgccctgccctggcaccagccgcccgtgccgggaattgccccggcggccaagcagatgggcaaatacgtggcccggcaaatcctcggaaaaaccggagcgccctatcgctacagggactacggccagctcgccaccatcgggcgcaattcagccgtcggcgtgctcggcaagctgcacctctcgggctacccggcgtggctgctgtggctgctcgcgcacatctacttcctgatcggcttccgcaaccgcatcgtcgtcatgatcgactgggcggcctcgtactggaccttcgagcgccacgcgcgcatcgtgatccgcggcaagccatag

SEQ ID NO: 562 - protein, 409 aa, Unknown
  Obtained from environmental sample
  SIGNAL (1)...(22)
  DOMAIN (4)...(304): Pyridine nucleotide-disulphide oxidoreductase
  DOMAIN (157)...(259): Pyridine nucleotide-disulphide oxidoreductase
  SITE (70)...(73): N-glycosylation site. Prosite id = PS00001
MDPHVVIAGCGFGGLFAARALAGRPVRVTVVDRTNHHLFQPLLYQVATAGLSAPAVAAPIRHILAGQRNATVIYGDATGIDPGQRALLLDGGERIAYDRLILATGADNSYFGNDAWREHAPSLKTLEDAYEIRRRVLLAFEHAERETDAAKRAAWLTFVVIGGGATGVELAGAFAEIARHTLPGEFRRFDPRNARVVLVEGIDRVLPSYPDTLSEKARKQLERLGVTVWLGKRVTAIDAEGVSLGPDRLAARTVIWAAGVAASPLGKSLGVPLDRAGRVIVNEDLTVPGHPEISVIGDLAALPWHQPPVPGIAPAAKQMGKYVARQILGKTGAPYRYRDYGQLATIGRNSAVGVLGKLHLSGYPAWLLWLLAHIYFLIGFRNRIVVMIDWAASYWTFERHARIVIRGKP

SEQ ID NO: 563 - DNA, 717 bp, Unknown
  Obtained from environmental sample
atgttcgcaggcaaggtcatcgccatcacgggcgcgtccgagggcatcggcgccgagatggcgcgccagctcgcgggcaagggcgtgtggctcgcgctcgcggcgcgcaaccagcagaagctggaagccgtcgccgccgactgccgctcgcgcggcgccgaggcggtggccgtgcggtgcgacgtgagcgtgcccgaggactgccgccagttcatcgagatcgcggtgcgcaagtacagctcgctcgacatactcgtgaacaacgccggcgtgtcggggcatgcgcgcctggaggacgtctccgacttcgcctggtacgagcagatgatgaaggtgaactacttcggcacgctgcactgcacgcgcttcgcgctgccgcacctcaggcagcggcgcggcctgctggtgggcatctccagcctcgccggcaaggtcggcgtgccggggcgcaccgcctacagcccgtccaaggccgcgcaggcgctgttcctggaagcgctgcgcctggagctgctggagagcggcgtggacgtgaccatcgtctatccgggcgtggtgcagaccgacatccggctgcacggctacggggccgacggccggcaggccggctacagcgggctgaaggaagacaacgcgatgaccgtgcaggcgtgcgcgcgccagatcctggacgcgatgcgcgagcgccgccgcgagctggctcgtgccgaattcttt

SEQ ID NO: 564 - protein, 239 aa, Unknown
  Obtained from environmental sample
  DOMAIN (5)...(172): short chain dehydrogenase
  DOMAIN (6)...(175): KR domain
MFAGKVIAITGASEGIGAEMARQLAGKGVWLALAARNQQKLEAVAADCRSRGAEAVAVRCDVSVPEDCRQFIEIAVRKYSSLDILVNNAGVSGHARLEDVSDFAWYEQMMKVNYFGTLHCTRFALPHLRQRRGLLVGISSLAGKVGVPGRTAYSPSKAAQALFLEALRLELLESGVDVTIVYPGVVQTDIRLHGYGADGRQAGYSGLKEDNAMTVQACARQILDAMRERRRELARAEFF

SEQ ID NO: 565 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgttcgcgttgttcagcaattcgtccgaaccccgccttcgcgagaacggcgcggccatccaatcgttgacggcgcacgcgcccgcaatgcatgaggaattgctgatcgaggccggcagggcggacctgttgcgcaagacaggctggctacagctttacgcgagcgatgccgcattcgccgccgatagcctgaaacggcgtatcgccgatgaggcaggatgcgactattcggtgctcgacactgaagccgccaaggagctcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggacctgttgcgcccgctcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgcgacccattatcggacctgcgccgcgccatgacggattgtggctgaatttcggccatgcccatctcggctataccctgggcccggtctccgcgcggctactggccgagttgataaacggagattcgccgatcagcgatccggcgccattcgccccgacgcgtttctga

SEQ ID NO: 566 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLFALFSNSSEPRLRENGAAIQSLTAHAPAMHEELLIEAGRADLLRKTGWLQLYASDAAFAADSLKRRIADEAGCDYSVLDTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAPTRF

SEQ ID NO: 567 - DNA, 1344 bp, Unknown
  Obtained from environmental sample
atgcgagtggtggtactgggcgccggcatcatcggcacatcgacggcatggcacctgctgcagcgcgggcacgaggtggtgctggtggaccgccagcccgacgcggcgctggagacgagctttgccaacgcggcgcagatttcggtgagctactgcgagccctgggccaaccgccaggcgccgctgaaggcgctgaagtggatgttcgacaagcaggcaccgctgctgtggcgcccgcagctcgacccggcgcagtggcgctggctgttgcagtttctgggccagtgcacggaccgcgccttcgagcgcaacgtggcgcagctggtggcgctgggcgcgtacagccacgccacgctcaagcagatggtggccgaaaccggcatcgactaccagcgcagcgagcgtggcatcgcccacgtgtacaccgatgccaaggcgtttgaagaggccgggcaggcggccgagctgatgcgccgccacggtgtgcagcggcgcgtggtttcacgcgaggagctgttgcgcatcgagcctgcgctggcaccggtggccgaccgcattgccggcggcacctacacccccaccgacgagcatggcgacgcgcgtgtgttcacccaggcgctggcccgactgtgtgccgcgcgcggcgctgagctgcgcttcggccatgacgttgagcggctggaggtggacggcggcgcggtgcgacgcgtgtgggtgcgcgcgcgcgccgacgggcgtgtatcggcgctgcaggccgatgcctacgtggtggcctgcggctcatacaccacgccgttgttggcgacagtcggaatgcgtgtgccgatctaccccggcaaaggctacagtgccacgctggctttgcgtgacccggcacgtgcgccgcaggtgagcctgctcgacgatggccgcaagatcgccatctcgcgcctgggtgaccggctgcgcgtggcgggcaccatcgagctggcaggctacgacctgcgtctggacaccccggtggcgcgtgcccgttgtcacatgttgctgcagcgcatcgaagagctgttccctggtgtggccgacacccgcacacccgagcagggcggcgagccgcagttctggtgcggcctgcgcccggccacgcccaccaacatcccgctcatcggccgcctgccgctgggccggctctggatcaacgccggtcacggcacgctgggctggacgcacggcgccggctcgggccgtgccttggccgaactgatcagcggcgagcgcccggcgctggcgatgcgtttcgtcggcttcgacgaacgcccccgcgcagccacgggtgcagccgccgtctcttctgccgtggggtga

SEQ ID NO: 568 - protein, 447 aa, Unknown
  Obtained from environmental sample
  DOMAIN (2)...(414): FAD dependent oxidoreductase
MRVVVLGAGIIGTSTAWHLLQRGHEVVLVDRQPDAALETSFANAAQISVSYCEPWANRQAPLKALKWMFDKQAPLLWRPQLDPAQWRWLLQFLGQCTDRAFERNVAQLVALGAYSHATLKQMVAETGIDYQRSERGIAHVYTDAKAFEEAGQAAELMRRHGVQRRVVSREELLRIEPALAPVADRIAGGTYTPTDEHGDARVFTQALARLCAARGAELRFGHDVERLEVDGGAVRRVWVRARADGRVSALQADAYVVACGSYTTPLLATVGMRVPIYPGKGYSATLALRDPARAPQVSLLDDGRKIAISRLGDRLRVAGTIELAGYDLRLDTPVARARCHMLLQRIEELFPGVADTRTPEQGGEPQFWCGLRPATPTNIPLIGRLPLGRLWINAGHGTLGWTHGAGSGRALAELISGERPALAMRFVGFDERPRAATGAAAVSSAVG

SEQ ID NO: 569 - DNA, 1260 bp, Unknown
  Obtained from environmental sample
gtgcgcgtactgattctcgggagcgggctggccggtgtgacgtccgcctactacctgcgcaagcacggatgcgacgtcaccgtcgtagaccgcgccgcgggcgcggggcgcgaaacgagcttcgcaaacggatcgatgatcacgccgagtctcgcggatccgtggaatgcaccgggtgtgttcggcgcactagtccgctcgttgggacgtgaggattcggcgatcctgctgcgcgtcgcggcgattccgtcgctgttcggctggggcatctcgttcctgaggaactccgcgtcgaagcgcttcgaacgcaactaccttcgtaacgtcggactggtgcattactcgcaaaaggtcatgcgggatctcatgcagacgcatgcgctgaaattcgactacgtcgacgacggcacgatgaagatcttccgcgacgaggcttcgttcgatcacggcatcaagatcgcgcattggttgaaacaggtgggaatagaacatcgccagctcgatgccgacggcgttgtgaggatcgaaccgaacctcgcgccggtagcggaccagatcgtcggaggcatcggttatccgggcgacgaaaccggcaacgcgcggatgttctgcgaggaaatgcggcgcgtgtgcgaggaatcgggcgtgcgcttccgtttcgccgagaacgtggtggagatcatccgcaagcgcaagagaatcgagggcctgcgaaccgcaaagcagacgttgtccgccgatgcatacgtgctggcggcgggcagcttcagcgcgaactggagcaagcagctcggcttcgacattccggttcgtcccgcaaagggatactccatttcgataccgatgcaccgttgggagccgaggccgcgcgtgccggtagtggacgattcgctgcacgctgcgctggtgccggtgggtggcgtgttgcgcgtggccggcacggccgaattcaccggctacgacgttacggtgaatccgaaacgtattgcgaatctcgtcaatctgttcggccgcgtgtatccgaagctcgccgaacgcgtgggcgatctcgacgtgcagccgtggtgcggcttgcggccgctaacgccggacggcatgccgatcgtgagcagatccccggtcgaaaacctctacctcaacaccggccacggcccgttgggctggtcgatggcgtgcggatcgggtcaggcgatcgcagacatgatcacgggcaatccgaccgcaatagacatgactaccttcgccttgcaacgcttctga

SEQ ID NO: 570 - protein, 419 aa, Unknown
  Obtained from environmental sample
  DOMAIN (2)...(401): FAD dependent oxidoreductase
  SITE (43)...(46): N-glycosylation site. Prosite id = PS00001
MRVLILGSGLAGVTSAYYLRKHGCDVTVVDRAAGAGRETSFANGSMITPSLADPWNAPGVFGALVRSLGREDSAILLRVAAIPSLFGWGISFLRNSASKRFERNYLRNVGLVHYSQKVMRDLMQTHALKFDYVDDGTMKIFRDEASFDHGIKIAHWLKQVGIEHRQLDADGVVRIEPNLAPVADQIVGGIGYPGDETGNARMFCEEMRRVCEESGVRFRFAENVVEIIRKRKRIEGLRTAKQTLSADAYVLAAGSFSANWSKQLGFDIPVRPAKGYSISIPMHRWEPRPRVPVVDDSLHAALVPVGGVLRVAGTAEFTGYDVTVNPKRIANLVNLFGRVYPKLAERVGDLDVQPWCGLRPLTPDGMPIVSRSPVENLYLNTGHGPLGWSMACGSGQAIADMITGNPTAIDMTTFALQRF

SEQ ID NO: 571 - DNA, 1248 bp, Unknown
  Obtained from environmental sample
atgaagattgtgattctcggtgccggcgtgatcggcgtcaccaccgcctggtatctggcaaagaccggacatgaggtcacggtgctcgaccggcagtccggcgccgcgctcgaaaccagttttgccaatgccggcgaggtctcgcccggctactcctcgccctgggcggcgcccggcattccgcaaaaggcgctcaagtggctcttcatggaacatgccccgctgatcgtgcgtccgaccatagatcccgccacggtacgctggatgctctccatgctgcgcaactgcacgaaggcccgctacacgcgcaacaaggggcgcatggtgcgggtcgccgaatattcgcgcgactgcctgatcgacttgcgggcggagaccggcatccagtatgatcagcgcacgcaaggcacgctggaggtctttcgtagtcagaaacaactcgacaatatcggcaaggatgttgaggtgctgaaggccggcggcgtgccgttcgagatactggacgcggccggctgtgcccgtgccgaacccggtatcgacgccagcaaaatcgtcggcgggctgcgactgcccaatgacgagaccggcgactgccacaagttcaccaccgccctcgccgccctcgctgaggccgccggcgtgcgcttcatatataatgtcgatattcgcggcctgcgccatgacgggcggcagatcaccgccgtggagaccgaccagggcgaatatatagcccatgtctttgtcggtgcgctcggcagctatacgccgaaactggtaaagccgcttggcctcgacttgccggtctatccggtgaaaggctattcgatcaccgtgccgatcatcaatgaggcccgtgccccggtgtcgaccgtgatggacgagacctacaaggtggccatcacccgcctgggcgatcgtatacgtatcggcggcatggccgagatcgcccgcttcaatatggatctgccgcccgcccgccaggccaccctcacccattccgtcgaggatctgttcaccggcgccggcgatcagtcacaggcgaaattctggtgcggtttgcgcccgatgacgcccgacggcacaccggtgatcggacgcacgcgctatgacaatttctggctcaataccggccatggcacgctcggctggaccatgtcctgcggctcggcgcgcgtattggccgatatgatcagtggcgtgaagccggagattgaaaccggcgacctgtcgatcagccgctacacttaa

SEQ ID NO: 572 - protein, 415 aa, Unknown
  Obtained from environmental sample
  DOMAIN (2)...(396): FAD dependent oxidoreductase
  SITE (96)...(99): N-glycosylation site. Prosite id = PS00001
MKIVILGAGVIGVTTAWYLAKTGHEVTVLDRQSGAALETSFANAGEVSPGYSSPWAAPGIPQKALKWLFMEHAPLIVRPTIDPATVRWMLSMLRNCTKARYTRNKGRMVRVAEYSRDCLIDLRAETGIQYDQRTQGTLEVFRSQKQLDNIGKDVEVLKAGGVPFEILDAAGCARAEPGIDASKIVGGLRLPNDETGDCHKFTTALAALAEAAGVRFIYNVDIRGLRHDGRQITAVETDQGEYIAHVFVGALGSYTPKLVKPLGLDLPVYPVKGYSITVPIINEARAPVSTVMDETYKVAITRLGDRIRIGGMAEIARFNMDLPPARQATLTHSVEDLFTGAGDQSQAKFWCGLRPMTPDGTPVIGRTRYDNFWLNTGHGTLGWTMSCGSARVLADMISGVKPEIETGDLSISRYT

SEQ ID NO: 573 - DNA, 1263 bp, Unknown
  Obtained from environmental sample
atgagcagaccgcgttccgtgatcatctgcggcgggggcatcgtcggcctctgcaccgcctactccctcgcccgcgagggcttccgggtgaccgtgctcgagcgcaacgcggagggcgcggactcctgcgcgcagggcagcgccggctatgtctcgccgagccacgtgatgccgctgtcggcgcccggcatggtctggcaggggctgaagtggatgacgaatccgcgcagtccgttctacatccagccgcggctggacggcgacctgttgcgctggggctggctgtttgcccgcgcctgcacgcgcggccacatgcgccgggcggcgcccctgctgcgcgacctgtgtctcgacggccgggcgcgtttcgttgaattggcggacatcacgggcaacgccttcgagctgcagaccgagggcattctgaatctctgccagactccggccgggctggagcacgaggcccgcgggctgggccggttggcgaacgacgtgggcatcgaggcccgggtgctcgatgcggcgcagacggcggcgctggagccgggcacgaagctggcggtggccggctcggtttattttcccatcgatgcgcacctgacgccgcggaagctggtgcccgcgctcaccggcctgctgcgcgagatgggggtgaagttccagtggaacaccagcgtgtacggctggcgcgccgaggccgggcgcatcgccgccgtgcacacgaccagcggcgatctggtggccgacgagtatgtgctcacgggcgggtcgtggtcgccgggcatggtggcgggcctcgacgtgcggctgccgatgcagccgggcaagggttatagcctgacgctggagcgcccgccgttccggctgacgaagtcgatgattctcgtggagcgccgcgtggcgatcacgcccatgggcggcgcgctgcgctttggcgggacgatggagatcagcggccacaacgaccgcgtccggcccgagcgcgtggagcagatcatcgccggggcctgtgcttttctgcccgagttggcggcgaaggattttgccggggtgcagccctggttcggctaccggccggtgtcgccggacggtctaccgtacctcgggcgcttccgtgcgcaccgcaacctgacggccgcctgcgggcatgcgatgctcggcgtgacgctggcgccgtcgagcggcgccctcgtcgccgatctgctgacggggcgcaagcccgccattccgctcggcctgctttcccctgatcgctacgcctga

SEQ ID NO: 574 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
  SITE (381)...(384): N-glycosylation site. Prosite id = PS00001
MSRPRSVIICGGGIVGLCTAYSLAREGFRVTVLERNAEGADSCAQGSAGYVSPSHVMPLSAPGMVWQGLKWMTNPRSPFYIQPRLDGDLLRWGWLFARACTRGHMRRAAPLLRDLCLDGRARFVELADITGNAFELQTEGILNLCQTPAGLEHEARGLGRLANDVGIEARVLDAAQTAALEPGTKLAVAGSVYFPIDAHLTPRKLVPALTGLLREMGVKFQWNTSVYGWRAEAGRIAAVHTTSGDLVADEYVLTGGSWSPGMVAGLDVRLPMQPGKGYSLTLERPPFRLTKSMILVERRVAITPMGGALRFGGTMEISGHNDRVRPERVEQIIAGACAFLPELAAKDFAGVQPWFGYRPVSPDGLPYLGRFRAHRNLTAACGHAMLGVTLAPSSGALVADLLTGRKPAIPLGLLSPDRYA

SEQ ID NO: 575 - DNA, 1584 bp, Unknown
  Obtained from environmental sample
atgaaacccgacggcggctccctgatcggcttcggctccggcggggccggggcttcgttccaggcctttgatcccgtgcgcggcgtcgcccttgagccgtcttttccgtcggccacgccggcggatatcgagcgggccgtgaagttggccgccgcggcggcgccggaactcgcgcgccggaccggggcggagcggaaccgtttcctgcgggccatcgccgacaacctggaggccaagggtgcggacttggtcgaccgggcggtgcaggagacgggtttggccgcggcgcggctgaccggggagatcggtcgcacggcccagcaactccggctctacggcgccgccgcggaggcgggcgactggctggacgcgcggatcgagacggcccgccccgaacgccggcccttgccgcggccggatcaccgctcgatgcgacgtccgctcgggccggtggtcgtgttcggtgcgagcaattttccctttgcctactcggtggccggcggggacacggcgtcggcgttcgcggccggctgtccggtgatcgtcaaggcgcacccggcgcatcccggcacgggcgagctggtcggccggctgattttgcacgccgtgcgggatctcggctggccggagggcacgttttcgctgctgttcgacgcggggttcgcggtcgggcaggcgctggtgcagcatccgctggtccgggcggtgggcttcaccggttcgctgcgcggcgggcgggcgctggcggatctcgccgcggcgcggccggagccgattcctgtctatgccgagatgggcagcatcaatcccgtcttcctgctgcccggcgcgctggccgagcgggcggagacgctggccgaggggttgcaggcctcggccacggcgagcgccggccagttttgcaccaatcccgggctgatcgtgctgccgcgcacggcggcggcggagcggtttgtcgaggagctgctgcggcggctggcatcgaccccggcggcaccgatgctgacgcccggcatccgccggcagttcgaggtggcgaccgcggagcgcgcggcgctgaccggcgtgcggccgctgcggccggggggcggagtggtcgccggcggcgtgacgccgcgctggtttgagacggacgcggcggtcttccggggcacgccggcgctggcggaggagattttcggcccgagttcgctcgtggtctggtgccgggacgcggtcgagatgcgcgcggtggcggaggcgttgcccggcagtctgaccgcgtcggtgcattgcagcgccggcgaggcggaggcggcgcgcggcctgctggatctgctcgcggagaaggcgggccggctgatcgtgaacggctggccgacggggttggaggtcagcgacgccatcgtgcacgccgggccctatccggcgacgagtgacggcgggcggagcacgtcggtcggcacgcgtgcgctcgaacggtgggggcgattggtctgttatcagaacacgcccgacgacctcttgccgccggagctgcgcaacgccaatccgctcgggctgcgtcggcaggtggacggcgagtggaccgggcgcggctggtag

SEQ ID NO: 576 - protein, 527 aa, Unknown
  Obtained from environmental sample
  DOMAIN (11)...(492): Aldehyde dehydrogenase family
MKPDGGSLIGFGSGGAGASFQAFDPVRGVALEPSFPSATPADIERAVKLAAAAAPELARRTGAERNRFLRAIADNLEAKGADLVDRAVQETGLAAARLTGEIGRTAQQLRLYGAAAEAGDWLDARIETARPERRPLPRPDHRSMRRPLGPVVVFGASNFPFAYSVAGGDTASAFAAGCPVIVKAHPAHPGTGELVGRLILHAVRDLGWPEGTFSLLFDAGFAVGQALVQHPLVRAVGFTGSLRGGRALADLAAARPEPIPVYAEMGSINPVFLLPGALAERAETLAEGLQASATASAGQFCTNPGLIVLPRTAAAERFVEELLRRLASTPAAPMLTPGIRRQFEVATAERAALTGVRPLRPGGGVVAGGVTPRWFETDAAVFRGTPALAEEIFGPSSLVVWCRDAVEMRAVAEALPGSLTASVHCSAGEAEAARGLLDLLAEKAGRLIVNGWPTGLEVSDAIVHAGPYPATSDGGRSTSVGTRALERWGRLVCYQNTPDDLLPPELRNANPLGLRRQVDGEWTGRGW

SEQ ID NO: 577 - DNA, 1239 bp, Unknown
  Obtained from environmental sample
atggcagcggacgcaatcgttctgggcgcggggattatcggggtgtcgactgcacttcatctggcaaggcgcggcaaatccgtggtgctggtggaccggcgcggccccggcgaggaaacctcgttcggcaatgccggcctcatccagcgcgaaggcgtggtgccctacgcctttccccagcagatcggcatgatcctcaaggtggcgctcaacaaccgcatcgacgtgcggtatgatttcggcgcacttccagcggttgccaaattcctcggccgttactggtggcactccaatacgggtcgccaccaggtgatcgcccgctcttatgcgacactgatcgaacagtcgattgcagagcatgacgacctgatccaagcatcgggtgcagaaaacctcatccgcaaggatggctggacgcaagcctttcgcacgcgggcgaagcaggatggcgaggttgccgaagccgagcgtctgaagcgcgaatacgacctcgatttcaaggtgctggatgccgccgaactcgcggccaaggagccgcatctcagcagtgatttcgtcggcggcctcacctgggtcgatccctggtcggtgaccgatccgcacgcgctgacactcgcctatgtcaaactgttcgaaagcctcggcggccggttcgtcaagggcgacgcgacaagccttgcccagaccgcgaccggctggaaagttttgaccgataacggccccgtcgagggcaaggacgtggtgatcgcgctcggcccctggtcagacacggtaacgaagccgctcggctataaattccttgtcggcgtcaagcgcggctatcacatgcattacggcctctccgacaacaaggtgctgaacggctggaccatggatgccgagcgcggttattttctcgccccaatggacaagggcataaggctgacgacgggcgccgaatttgcacttcgcgacgcgccgaagacgccagtgcaactgggccgcgccgaagccgttgcccgcaccatctttccgctcggggaacggctggacaaggagccctggatgggcgcgcgcccctgcaccccggacatgatgcccatcatcggcaaggcaccgcgccatgaaggtctgtggtttgccttcggccatgcccatcacggcctgacccttggcccggtcaccggccgggtgattgccgaacagatctgcggagaaaaaccctttatagacaccacaccataccggcccgagcggttc

SEQ ID NO: 578 - protein, 413 aa, Unknown
  Obtained from environmental sample
  DOMAIN (4)...(395): FAD dependent oxidoreductase
MAADAIVLGAGIIGVSTALHLARRGKSVVLVDRRGPGEETSFGNAGLIQREGVVPYAFPQQIGMILKVALNNRIDVRYDFGALPAVAKFLGRYWWHSNTGRHQVIARSYATLIEQSIAEHDDLIQASGAENLIRKDGWTQAFRTRAKQDGEVAEAERLKREYDLDFKVLDAAELAAKEPHLSSDFVGGLTWVDPWSVTDPHALTLAYVKLFESLGGRFVKGDATSLAQTATGWKVLTDNGPVEGKDVVIALGPWSDTVTKPLGYKFLVGVKRGYHMHYGLSDNKVLNGWTMDAERGYFLAPMDKGIRLTTGAEFALRDAPKTPVQLGRAEAVARTIFPLGERLDKEPWMGARPCTPDMMPIIGKAPRHEGLWFAFGHAHHGLTLGPVTGRVIAEQICGEKPFIDTTPYRPERF

SEQ ID NO: 579 - DNA, 1254 bp, Unknown
  Obtained from environmental sample
atgaagatcaccattctcggagccggcgtcatcggcgtcacctcggcctattacctcgcaaaggctggccatgaggtgacggttctcgaccgacaggccgggccggcgctggaaaccagctttgccaatgccggcgaagtgtcctttggctactgctcaccctgggccgcccccggaattccgcaaaaggcgctcaaatggatctttatggagcatgcaccgctgatcctgcgccccaagctcgatgtcgccatgctgtcctggatgttccgcatgctctccaactgcacatcggagcgttatgcgctgaacaagagccgtatgctcaggcttgccgattacagccgtctggcgcttgccgaagtgcgcgccgacacagccatcgcctatgacgaacgcatgcagggcacgctgcaattgtttcggaccgaagcacagctggaagcatcggccaaggatgtgaaggcgctcgccgccgatggtattccttacgaagttctcgatcccgccggctgcatccgcactgagccagcgcttgcccatgtccgcgaaaagatcgtcggcggccttttgaccccgaaggacgagacgggcgactgcttcaagttcaccaatgcgcttgcgaaaaaggccgaagaactcggcgtcaccttccagtggggcgtcgatatcaaggcgctcgaagtgtccggcggcacggtcaagggcgtgatcaccggtcgcggccgcatgacgagcgatgccgtggtggtggcgctcggcagttattcgcccttgctggtgaaaccgcacggcatcggcctgccggtctatccggtaaaaggctattcgctcaccatcccgatcaccgatgccagccgcgcaccggaatccaccgtgatggacgagacctacaagattgccatcacgcgcctgggtgaccgcatccgcgttggcggcatggccgaaatttcgggctataccaatgatctcggccttgcccgccgccgcacgctcgaacattccgtgacggatcttttccccggcggcgatgtgaagaaggcggatttctggtcgggccttcgcccgatgacgccggacggtacgcctgttatcggcgcgaccaaggtgcgcaacctcttcctcaacaccggccatggcacgctcggctggacgatgagctgcggctcggccaaggtgctcgccgatatcgtcagtggccgaacggccgatatcgagacgaaggatcttgccgtcgcgcgttacgccgcctga

SEQ ID NO: 580 - protein, 417 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKITILGAGVIGVTSAYYLAKAGHEVTVLDRQAGPALETSFANAGEVSFGYCSPWAAPGIPQKALKWIFMEHAPLILRPKLDVAMLSWMFRMLSNCTSERYALNKSRMLRLADYSRLALAEVRADTAIAYDERMQGTLQLFRTEAQLEASAKDVKALAADGIPYEVLDPAGCIRTEPALAHVREKIVGGLLTPKDETGDCFKFTNALAKKAEELGVTFQWGVDIKALEVSGGTVKGVITGRGRMTSDAVVVALGSYSPLLVKPHGIGLPVYPVKGYSLTIPITDASRAPESTVMDETYKIAITRLGDRIRVGGMAEISGYTNDLGLARRRTLEHSVTDLFPGGDVKKADFWSGLRPMTPDGTPVIGATKVRNLFLNTGHGTLGWTMSCGSAKVLADIVSGRTADIETKDLAVARYAA

SEQ ID NO: 581 - DNA, 1260 bp, Unknown
  Obtained from environmental sample
atgaagccggacgtgattgtactcggcgccggaatggtcggcgtctcgacggctctccatcttcaaagtcgcggccatgacgtggttctggtcgaccgccgtccacccggcgaggaaacctcgttcggcaatgccggggtcatccagcgcgaggccgtggaaccctatgccttcccccggtccgcgctgcagctcctgcgcttcgcgtgcaagaccggcccggaggtgaactatcattttcgcgccctgcccggtctggtggggccgcttctgcggtactggtggttttccgcgcccgcccgctaccccgccatcgccgccgcgcatgcaaggctgatcgagcactgccttggcgagcacgaggtgctgatcgggcaggccggggcggacgatctggtgcggcgcgacggtttccgctttgtctatagatccgccagggccctggagaccgacgcggcgcaagcccggcaactggcacaagaccatggccttgcctgcgatcttcttgacggcgatgccctggcacgggccgagccggcgctgaaacagccgctggctggcgcgcttcactggcgcgatccctggacggtcagctcgccgggagagcttgtcgtccgctatgccgcgctgttccggcggaagggcggtaccgtgctgaccggcgatgcggcaagcctggcccggcatggaaatatcggctgggcggtgatgacggacgacggcaagctggaggctgccaatgcggtgattgcgcttggcccctggtcggtggagaccgcaaggcgcctcggataccgactgcctctgttcgtcaagcgcggctatcatcgccactaccggcccccggatggcgccgcgcggctggcactgccgatgctggatgcgcagaagggggtcgtgctggcgcccatggcacaggggctgcggattaccaccggcgccgaattcgcccggctcgaagcgccttcgacgccggtgcagatcgacggtgccgcccgggcggcggccgagttgctggatatcggcacgccggtcgagccggcaccgtggcgtggcgcacggccatgcaccccggacatgctgccggtggtcggtgccgcgccgcgccacaatggcctgtggttccatttcggtcatgcccatcagggcttcacgctcggccccgtcaccggcaggctcatcgcggagatgatcgggggcgaacgccccttcctcgacccgtcaccctatgccgtcacccgctttgctggcgggcgctga

SEQ ID NO: 582 - protein, 419 aa, Unknown
  Obtained from environmental sample
  DOMAIN (4)...(397): FAD dependent oxidoreductase
MKPDVIVLGAGMVGVSTALHLQSRGHDVVLVDRRPPGEETSFGNAGVIQREAVEPYAFPRSALQLLRFACKTGPEVNYHFRALPGLVGPLLRYWWFSAPARYPAIAAAHARLIEHCLGEHEVLIGQAGADDLVRRDGFRFVYRSARALETDAAQARQLAQDHGLACDLLDGDALARAEPALKQPLAGALHWRDPWTVSSPGELVVRYAALFRRKGGTVLTGDAASLARHGNIGWAVMTDDGKLEAANAVIALGPWSVETARRLGYRLPLFVKRGYHRHYRPPDGAARLALPMLDAQKGVVLAPMAQGLRITTGAEFARLEAPSTPVQIDGAARAAAELLDIGTPVEPAPWRGARPCTPDMLPVVGAAPRHNGLWFHFGHAHQGFTLGPVTGRLIAEMIGGERPFLDPSPYAVTRFAGGR

SEQ ID NO: 583 - DNA, 1233 bp, Unknown
  Obtained from environmental sample
atgagattcgataccgtggtgctcggcgccggcatagtcggcgtgtgcgtggcggtgcatcttcagcaacgcggtcgcgcggttgcgttgatcgatcgcaagcagcccggcaatgaaacgtcattcggcaacgccggactgatccagcgcgaaggcgtctatccgtacgcttttccgcgcggactcggcacgttgctgcgctatgcgcgcaaccagtcgcccgacgttcgctatcacgccgacgcgatgctcgaagccgtgccgttcctgtggcgctactggcgcaattctcatcccgcgaagcatgcacggatcgcacggtcgtacgcgacgctgatcgagcattgcgtgaccgaacaccgcgcgctcgccgccgcggccggtgcgagtgcgctgctgcgtccgatcggctggatcaaggtatttcgcaaccatgcggcacgggaggccgaaatccggcttgccgagcaatggcaccgcgaatatggcgtcgaattcgaagcgctcgacgcgccgcgcctgcaacaactcgaacccgacctcgacaagcgtctgcaaggcggtctgcgctatccgcaagcggactccgtcagcgatccgaatgcgctcgtcaccgcgtacgcgcggtatttcgaagcgctcggcggacggttttttttcggcgatgcggcgacgctgcgcgagggctggcaagtcgatacccaacaggaccccgtcaccgccgactcggtggtcgtggcgctcgggccgtggtcggaccggctggtctcgcggctcggctaccggctgccgctcgcggtaaagcgtggatatcacatgcactacgcgccgcgccaaaccacccggctcaatcatccggtgctcgatgccgaatacggttatgtgctggcgccgatggctcgcggtatccgtctgacgacgggcgcggaaatcgcccgttccgacgcagacaaaacgccggtgcaactcgacgcggtcgaaccgatcgcgcgcacgctgttcccgctcggcgagcgtctcgacagcgaaccgtggatgggccgccggccctgtacgccggacatgatgccgatcatcgggccggcgccgcatcatcagggcttgtggttcgcgttcggtcacgcgcaccacggtctgacgctcggtccggtgaccggacggctgatcgccgagatgatgaccggcgagcaaacgctcgtcgatccacggccgtttcgggtggagcgcttctag

SEQ ID NO: 584 - protein, 410 aa, Unknown
  Obtained from environmental sample
  DOMAIN (4)...(392): FAD dependent oxidoreductase
  SITE (38)...(41): N-glycosylation site. Prosite id = PS00001
MRFDTVVLGAGIVGVCVAVHLQQRGRAVALIDRKQPGNETSFGNAGLIQREGVYPYAFPRGLGTLLRYARNQSPDVRYHADAMLEAVPFLWRYWRNSHPAKHARIARSYATLIEHCVTEHRALAAAAGASALLRPIGWIKVFRNHAAREAEIRLAEQWHREYGVEFEALDAPRLQQLEPDLDKRLQGGLRYPQADSVSDPNALVTAYARYFEALGGRFFFGDAATLREGWQVDTQQDPVTADSVVVALGPWSDRLVSRLGYRLPLAVKRGYHMHYAPRQTTRLNHPVLDAEYGYVLAPMARGIRLTTGAEIARSDADKTPVQLDAVEPIARTLFPLGERLDSEPWMGRRPCTPDMMPIIGPAPHHQGLWFAFGHAHHGLTLGPVTGRLIAEMMTGEQTLVDPRPFRVERF

SEQ ID NO: 585 - DNA, 1338 bp, Unknown
  Obtained from environmental sample
atgaaaatcatcgttcttggcgcaggcatcattggcatcagcaccgcttggcatctgctcgagcgcggccatgaggtcaccatcgtcgaccgccaacccgacgccgccctggaaaccagtttcgccaatgcggcacagatttcggtcagctactgcgagccctgggccaaccgcgacgccccggcaaaactcgtgaagtggatgttccgcaacgacgcgccgctgctgttccgtccgcagctggattggcagcaatggcgctggggcctgcaatttctgagccagtgcaatgacgcggccttcgagcgcaacgtgcagcagatcgtggccctgggcgcctacagccatgtggcgctgaaggaaatcgtgcgccagaccggcatcgaatacaaccgcctggagcgcggcatcgcccactactacaccgaccagaagtcgttcgattccgccggctcggccgcggccttgatgcgcaagttcggcgtcgaccgcaaggtggtgagccgcgacgagttgatgcgcatcgagcccgcgttcaaggcgttcgcgcaccgcatcgtcggcggcacctacacggccagcgacgagagcggcgatgcgcgcgtcttcacgcaggaactggccaagcgctgcgcggcgcggggcgcgcagttcctctacaaccacgacgtcatgcgcctgaacaaggatggcgacgctattaaatcagtagctgtacgcgctcgttccaccggcgctgcaggcccaaaagaccaagtattgcaaggcgatgccgtggtcgtggcctgcggctcctacagcgcgccgctgctgcgtaccgtgggcgtggacctgccgatctaccccggcaagggctacagcgcaaccttcaagctgctgcggcccgagctcgcgccgatggtctccaccatcgacgacgaagtgaagtgcgccatgagccgcctgggcgaccacctgcgcgtggccggcaccatcgaggtcggcggctacgacctgtcgctcgacacgccgctggcgcgcgcgcgctgccagatgctggccgaccgcatcgaggccgtgttgcccggcgtctgcgacacgcgcaacgaagcccagggcggccagccgaatttctggaccggcttgcgcccggccacgccgaccaacatcccctacatcggccgcaccagggtcggcaagctgtgggtcaacgccggccacggcacgctgggctggacccacggcgccggttcgggcaaggccatggccgaactcatcagcggcgagcagccggcgatgcagttcggattccatggattcaaggccggccatcgccacggggaaatggcgaacgcctga

SEQ ID NO: 586 - protein, 445 aa, Unknown
  Obtained from environmental sample
  DOMAIN (2)...(418): FAD dependent oxidoreductase
MKIIVLGAGIIGISTAWHLLERGHEVTIVDRQPDAALETSFANAAQISVSYCEPWANRDAPAKLVKWMFRNDAPLLFRPQLDWQQWRWGLQFLSQCNDAAFERNVQQIVALGAYSHVALKEIVRQTGIEYNRLERGIAHYYTDQKSFDSAGSAAALMRKFGVDRKVVSRDELMRIEPAFKAFAHRIVGGTYTASDESGDARVFTQELAKRCAARGAQFLYNHDVMRLNKDGDAIKSVAVRARSTGAAGPKDQVLQGDAVVVACGSYSAPLLRTVGVDLPIYPGKGYSATFKLLRPELAPMVSTIDDEVKCAMSRLGDHLRVAGTIEVGGYDLSLDTPLARARCQMLADRIEAVLPGVCDTRNEAQGGQPNFWTGLRPATPTNIPYIGRTRVGKLWVNAGHGTLGWTHGAGSGKAMAELISGEQPAMQFGFHGFKAGHRHGEMANA

SEQ ID NO: 587 - DNA, 1290 bp, Unknown
  Obtained from environmental sample
atgcgtgccgcccgaacatctcaagtcctctcaatgcaacttcacatcaaccgccaagccgacgtactcgttctcggagcggggatcgtcggcgtctgcaccgccttgcaccttcaggcccgcggtcgcgatgtcatccttgtcgaccggcgctcgcctggagaggagacaagtttcggcaatgccggactgatcgagcggtcttcggtcgtgccctacgcgtttccgagaaacatcggcgctatccttgcctatctgaccaaccgatcgccggcggtgcgctacgacccgcgatttctccccgctatcctgccccggctggttcgctactggtggcattcggcgccgggccgcctggagcgggcagccgaggtgatgctgccgctgatcgagcgcagcgtcgacgaacacgatgcgctgatcaggcaggccgggatggagcgctacgtccgtcgcgaaggctggatcgagctgttccgctcaccggctctcttcgagcgggctaaacgggacgtcgcggctttggaacgcttccgtcttcggttcgatattctcgatgctccgcgtttgcaggaccgcgtgccgtcgctgcgcgacggcgtggccggtggcattcactggctggacccctggtcggtcagcgatcccggcgcggtcacgcgcggatacgcacaactcttcctcgatcgcggcggatcttttctgcgagcggaggcgcgctcgctgcgccggcagcctgaagggtggtcggtggacgacagcgacggcatccagcttggggccaaggaagcggttgtcgcgctcggaccgtggtcggaggaaatctaccggcctctcggataccggttccccatgttcgtcaagcgggggtatcaccgacattacagcgccgaaagcggcgccacgctccggcatccaatttgcgatgtggaagccggtttcgtcctgacgccgatgacgcgcggcataaggctgacgacgggtgtcgaactggcgccgcgagattcgcgcccgacgccgacgcaactcgagctggcggaaacagtcgcgcgcaggatattcccgctcggcaggtccatggaccagacgccctggttgggcgccaggccatgcctgcccgatatgagaccggtgatcggccccgcgccacgtcataaaggtctgtggttcgctttcggacacgcgcatcatggcttcacgctcggtccgatcaccggacgcattctggccgaggcgatgaccggcgaaaagccggcggcggacatatcgcgctacgcggtccgatggtga

SEQ ID NO: 588 - protein, 429 aa, Unknown
  Obtained from environmental sample
  DOMAIN (21)...(412): FAD dependent oxidoreductase
MRAARTSQVLSMQLHINRQADVLVLGAGIVGVCTALHLQARGRDVILVDRRSPGEETSFGNAGLIERSSVVPYAFPRNIGAILAYLTNRSPAVRYDPRFLPAILPRLVRYWWHSAPGRLERAAEVMLPLIERSVDEHDALIRQAGMERYVRREGWIELFRSPALFERAKRDVAALERFRLRFDILDAPRLQDRVPSLRDGVAGGIHWLDPWSVSDPGAVTRGYAQLFLDRGGSFLRAEARSLRRQPEGWSVDDSDGIQLGAKEAVVALGPWSEEIYRPLGYRFPMFVKRGYHRHYSAESGATLRHPICDVEAGFVLTPMTRGIRLTTGVELAPRDSRPTPTQLELAETVARRIFPLGRSMDQTPWLGARPCLPDMRPVIGPAPRHKGLWFAFGHAHHGFTLGPITGRILAEAMTGEKPAADISRYAVRW

SEQ ID NO: 589 - DNA, 1254 bp, Rhodococcus erythropolis DSMZ 44522
atgggaactcgtcagagccccgatcgtgtggtcgtggtcggtgcgggtgttgtcggattgtcgacggcctggttcttgcaggaacgtggagtcgaggtcaccgtcgtcgatcgcgacggcgtcgcagccgacgcgagctggggcaacgccggttggcttgcccccgcattgacgcttccgctgcccgaacccgcagtgctccaatacggcttgcgcgcgatgctcagcccgtcgtccccggtgtacgtgccactgaccaccgatctgaagctgattcggttcctggtcgggttcgcgcgccactgcacgccgtcgaagtggcaggaagcgatgtcggtctacaccgaggtcaaccgaacagccttgggcgcgtacgacgaactcgccgacggtggcgtcaaagagctgacccgcctggccgatcctttcctcgccgcgtttgcgtccgagaaggaccgacagactttggtggacgagttccatcacgtcgaggccgcgggcggcgaggtcgacttcgacctcctcgactacgacgcgattcattcgctcgagccttcactcggccagggtgtgaaagccggtttgcgtctgcgtaatcagcgtttcatcgatcccccattgttcgtgaactcgttggcggacgcggttcgtgaacgcggtggagaaatcgtcagcggtttcgacgtcacgcagatcgacgatcgggtcggcggagtcactgttcgcagtgcacacggtgattcacgcgacggcgacgccgtggtcatctcgagcggtgcccgcttgaacaagctctccgcaccgttcggtgtgcgcaaactggtgcaggccggacgcggatacagcttcagtgtcaagcccgagcacctccccaagaaccctgtgtatttccccacccagcgcgtcgcatgcactccgttgcacgatcgcttccgagtcgccggaatgatggaattccgcagccctgacgcgccgctggatccgcgccgcgtgcaggcgatcatcgatgcggccaagccgatgctcagcggcatcgactggactgcacgggaagaggaatgggtgggatcacgaccgtgcactaccgacggcttgccgttgatcggcgccacgaagtcgccgcgggtgcacgtcgccggtggtcacggaatgtggggaatcgccctgggtccgttgaccggaaagatggtggccgactcgatgaccggcgctcagacgccaaccgtcatgcgccacttcgatccgctgcgctga

SEQ ID NO: 590 - protein, 417 aa, Rhodococcus erythropolis DSMZ 44522
  DOMAIN (9)...(400): FAD dependent oxidoreductase
  SITE (119)...(122): N-glycosylation site. Prosite id = PS00001
  SITE (352)...(360): Myb DNA-binding domain repeat signature 1. Prosite id = PS00037
MGTRQSPDRVVVVGAGVVGLSTAWFLQERGVEVTVVDRDGVAADASWGNAGWLAPALTLPLPEPAVLQYGLRAMLSPSSPVYVPLTTDLKLIRFLVGFARHCTPSKWQEAMSVYTEVNRTALGAYDELADGGVKELTRLADPFLAAFASEKDRQTLVDEFHHVEAAGGEVDFDLLDYDAIHSLEPSLGQGVKAGLRLRNQRFIDPPLFVNSLADAVRERGGEIVSGFDVTQIDDRVGGVTVRSAHGDSRDGDAVVISSGARLNKLSAPFGVRKLVQAGRGYSFSVKPEHLPKNPVYFPTQRVACTPLHDRFRVAGMMEFRSPDAPLDPRRVQAIIDAAKPMLSGIDWTAREEEWVGSRPCTTDGLPLIGATKSPRVHVAGGHGMWGIALGPLTGKMVADSMTGAQTPTVMRHFDPLR

SEQ ID NO: 591 - DNA, 1245 bp, Unknown
  Obtained from environmental sample
atgcagtttgacgtcattgtcctcggcgccggaatcgtcggggtctcggtggcccttcacctcgcggaccgcggtcggtccgtcgccctcgtcgaccggcgcggtgccggcgaagagacatccttcggcaatgccggcctgatccagcgcgaaggggtggcgccgcatgcctttccccaggggctgggcgccttgctcacctatgcccgcaacgaccgcatcgacatgcactaccatctcgctgcgcttccgcgcattgcgccgcttctcgcgcaatactggtggcactcccgcaccgcgcgctaccgcgaggtcatgcgcacctatgcccccctcatcgcgcattcgatcagcgagcatgcgccgctgatcgcgcgtgccggggcagggcatctggtcgaaaagaagggctggtaccgcctctatcgcacggaagcgggattcgccgccgccgccgccgaggcgcgccgcctcttcgagaccttcggtgtcggctatgccgaactggatggcgacgagatgcgccggcgccagccgggcctggggctggcggtgcggggcgccgtgcagtggacggagccctggaacgtcagcgatccgggtggcctcgtctcggcctatctcgggctgttcgagcagcagggcgggcaattcgtccgcgccgacgcgctgcagcttgccccgcacggcgccggctggcgcatgccggtgcccggcggcaccatcgaggcgggcgaagtcgtggtggcgctcggcccctgggccggcgatctcgtttcgcgcctcggctatcgcctgccgctcggcgtcaagcgcggctaccacatgcactatgcccagcccgacgatgccccgctcgccaactgggtgctcgatgccgagcgcggctacatgctcaccccgatgcagcgtggcatccgcctgaccaccggcgcggaattcgccttgcgcgacgcccacgcaacgccggtgcaactggcccgggccgagaccgtggcgcgggagctgtttccgcttggcgcccgtctcgatgccgaaccctggcgcggcgcacgcccgatcacgcccgacatgatgccggtcatcggcgcggcgccgcgccatcgcgggctgtggttcgcctttggccatgcccatcacggcctgacccttggcccggttaccggccgcctgatcgccgagatgatcaccggcgccccgaccgtggtcgatcctgcacccttttcgccgcagcgcttcctgtga

SEQ ID NO: 592 - protein, 414 aa, Unknown
  Obtained from environmental sample
  DOMAIN (4)...(395): FAD dependent oxidoreductase
  SITE (199)...(202): N-glycosylation site. Prosite id = PS00001
MQFDVIVLGAGIVGVSVALHLADRGRSVALVDRRGAGEETSFGNAGLIQREGVAPHAFPQGLGALLTYARNDRIDMHYHLAALPRIAPLLAQYWWHSRTARYREVMRTYAPLIAHSISEHAPLIARAGAGHLVEKKGWYRLYRTEAGFAAAAAEARRLFETFGVGYAELDGDEMRRRQPGLGLAVRGAVQWTEPWNVSDPGGLVSAYLGLFEQQGGQFVRADALQLAPHGAGWRMPVPGGTIEAGEVVVALGPWAGDLVSRLGYRLPLGVKRGYHMHYAQPDDAPLANWVLDAERGYMLTPMQRGIRLTTGAEFALRDAHATPVQLARAETVARELFPLGARLDAEPWRGARPITPDMMPVIGAAPRHRGLWFAFGHAHHGLTLGPVTGRLIAEMITGAPTVVDPAPFSPQRFL

SEQ ID NO: 593 - DNA, 1272 bp, Unknown
  Obtained from environmental sample
atggcaccgcaatcggaaacggctttcatggcggaaacccacgacatcatcgttctcggcggcggcatcgtcggcgtttcgaccgcgctccatcttcagcggcgggggcgcagcgtcaccctcgtcgaccgccgcgagccgggcgaggagacgtccttcggcaatgccggcgtgatcgagggcgggacctacattccgatcgcgtttccgcacgatccggtcgagatcctgcgctatgcgaccaaccgccagtcggcgctgcatttccactggtcgttcctgccgcgcatcgcgccgtggctgtgggcgctctaccggaactcgacggaagacaagctcagggccaacggcagggcgatcatggcgctgaccgcagatgccatcggggagcacaaggcgctgctcgtcgaggcgaaggcggaggcgctgctgcgcatgaccggatggctgcgcgtctatcgcgacgaggcggagctcgccgccgacagcctcgagatgcggctcgccgacgaggagggcttcgcctacgacgtgctcgatgccgacgccgcgcgggagatcgagccgcatctggcgccggtgttcgccagggcggtgcactggcactcgatcgcctcggtgtcggatccgggggcggtgaccaaggccatcgccggactgttcgcggccgagggcgggcggatcgaacggggcgaggcgcggcggctcgtgcgggacggcgggcgctggcgggtggagaccgcagacggggcgctcgaagcgggcgaggtggtggtggcgctcgggccgtggtcgatggacctgctgcggccgctcggctgccgtctgcccttcgcggtcaagcgcggctaccattgccattacggcgcggtgggaaacgccgctctctcgcgtcccgtcgtcgacagccgctacggctatgcgctggcgccgatggcgaggggaatccggctcaccaccggaatcgaactggccggccgcgacgcgccgccgacccccgtccaggtcgatcgcgcagagcgccgcgcccgcgagctctttccgctggcggagccggtcgatgccgaaccgtggctcggccgccggccctgcttcccggattcgcgcccggtgatcgggccggctcccggccatcccgggctgtggctcaatttcggccacgcccatctcgggttctcgctggggccggtgagcgggcggctcgtcgcccagatgatgacgggagaggcgccgctcgccgatcccgcgctctttgcggcgacgcggttctga

SEQ ID NO: 594 - protein, 423 aa, Unknown
  Obtained from environmental sample
  DOMAIN (15)...(405): FAD dependent oxidoreductase
  SITE (108)...(111): N-glycosylation site. Prosite id = PS00001
MAPQSETAFMAETHDIIVLGGGIVGVSTALHLQRRGRSVTLVDRREPGEETSFGNAGVIEGGTYIPIAFPHDPVEILRYATNRQSALHFHWSFLPRIAPWLWALYRNSTEDKLRANGRAIMALTADAIGEHKALLVEAKAEALLRMTGWLRVYRDEAELAADSLEMRLADEEGFAYDVLDADAAREIEPHLAPVFARAVHWHSIASVSDPGAVTKAIAGLFAAEGGRIERGEARRLVRDGGRWRVETADGALEAGEVVVALGPWSMDLLRPLGCRLPFAVKRGYHCHYGAVGNAALSRPVVDSRYGYALAPMARGIRLTTGIELAGRDAPPTPVQVDRAERRARELFPLAEPVDAEPWLGRRPCFPDSRPVIGPAPGHPGLWLNFGHAHLGFSLGPVSGRLVAQMMTGEAPLADPALFAATRF

SEQ ID NO: 595 - DNA, 1257 bp, Unknown
  Obtained from environmental sample
atggcggaactcaaggccgacgttctcatcctgggcgccggcatggtcggcgtcggcgcggcattgcatctgcaacagcgcgggcgcgacgtcatcctcgtcgacaagcatgagctggcgggcgaggagacgagctacggcaatgcggggatcatcgaggccgcctcggtctttccctacatgtttcccagggagatcacggagatcctgcgttacgcgtcgaaccgtgcgccgcaggtgcgctatcatttcgccgatctgccgtccttcctgccgtggctgctccgttactatctggcctcgcggcccgatcgggcgctgcgcggcgcgatgggcgtgctgccgctgatccgccgcagcctcgtcgaacatgaggcgctgattgcggaagccggcgtgccggagctgttgcgcaagagcggctggatcaagctgtttcgctccgaggcgacaatgaagggagcgatcgccgaattcgagcgggccaggcaatatggcgtggaggccgacatcctcgatgcaggcgcgattgccgcgcgcgagccgaacctcagtggcgatttcgcgggagcacttcacttcacgcagcccggcttcgtgccggaccccggcggccttgccaaagcctacgccgcgctgttcaggcgcaagggcgggcgatttgtggtgggcgatgcccggacgttgcaacagcagcctgaccggcgctggcgcgtgacgacggcggaggggtcggcggtggcgcgcgaggcggtgatcgcgctcgggccatggtccgatctggtgttcggcccgctcggctattcgattccgctggcggtcaagcgcggctatcatctgcatctcgccccgcgcggcaatgccgtgctcaatcatcccgtgctcgatgccgaccagggcttcgtgctggcgccgatgaaccgcggcatccgcctgacctcgggcgtggagtttgcccgccgcgatgcgccggcaactcctcgccagatcgagcgtgcgctgccgaaggcgcgagggctgtttccgctcggcgaggcggtcgacgcccagccctggaagggcgcgcggccctgcttgccggacatgctgccggtgatcggccgggcgccgcgccaccagggcctgtggttcgacttcggccaccagcatcacgggctgacgctgggtcccgtgtccgggcgcctgctggcggagatgatgaccggggaggcgccgttcgccgacccggcgccgtttgccgccgagcgcttcggctaa

SEQ ID NO: 596 - protein, 418 aa, Unknown
  Obtained from environmental sample
  DOMAIN (7)...(399): FAD dependent oxidoreductase
  SITE (185)...(188): N-glycosylation site. Prosite id = PS00001
MAELKADVLILGAGMVGVGAALHLQQRGRDVILVDKHELAGEETSYGNAGIIEAASVFPYMFPREITEILRYASNRAPQVRYHFADLPSFLPWLLRYYLASRPDRALRGAMGVLPLIRRSLVEHEALIAEAGVPELLRKSGWIKLFRSEATMKGAIAEFERARQYGVEADILDAGAIAAREPNLSGDFAGALHFTQPGFVPDPGGLAKAYAALFRRKGGRFVVGDARTLQQQPDRRWRVTTAEGSAVAREAVIALGPWSDLVFGPLGYSIPLAVKRGYHLHLAPRGNAVLNHPVLDADQGFVLAPMNRGIRLTSGVEFARRDAPATPRQIERALPKARGLFPLGEAVDAQPWKGARPCLPDMLPVIGRAPRHQGLWFDFGHQHHGLTLGPVSGRLLAEMMTGEAPFADPAPFAAERFG

SEQ ID NO: 597 - DNA, 1317 bp, Unknown
  Obtained from environmental sample
atgaaggtactggtactgggcggtggcgtaatcggcgtatcgagcgcttatttcctggcgaaggctggctgcgacgtgacagtcatcgagcgtcagcccggcgtggcgttggagacgagttttgccaatgccggccagatctccccgggttatgctgcgccatgggctgcgcctggcatcccgaccaaggcggtcaagtggctgttccagaaacacgccccactggctatccgcccggatggcaccctgcaccagctcaagtggatggcgcagatgttcgccaactgcaatgaaaagcgctatcacgtcaacaaaggccgcatgatgcgcctggccgagtatagccgtgacgtgatccgcacgttgcgcgccgaaaccggcatcaaatatgaaggccgctcgcttggcacgctgcagattttccgttcacaggcgcaagtcgatggcgcggcgaaagacatcgccgtgctgcaggaatgcggtgtgccgtttgaagtgctcgaccgcgatggctgcgcacgagctgaaccagcgttggcccaggtgaagcacaagatcgccggcggcctgcgcttgcccaacgacgaaaccggtgattgccaactgtttaccatgcgcctggccgatatggcaaaggcacttggtgtgacctttcgtttcgacaccgaaatcgacgacatcctgttcgatggccgccgcatcaacggtgtgcggattggcgaagaaatcgtccgcgccgatcactacgtgatggcgctcggcagctactcgccgattattggccgcaaactagggctcgacttgccagtgtatccggtgaagggttattcgctgacaatcccggtcctcgacgaaacacgcaccccggtatcgaccatcctcgacgaaacctacaagatcgccctcacccgcttcgataaccgcatccgcgtcggcggcatggctgagctgtcgggttacgatctgcgcctgaacccgaaacgccgcgccacgctggaaatggtggtgaacgacttgttcccgggcggtggcgatgtaccggccgccagcttctggactggcctgcgcccgatgacacccgatggcaccccgctggtcggcgcaaccccgatcgccaacctgtcgctcaacaccggccacggcacgctgggctggacgatggcatgcggctccggcaagttgctcgccgatctgatcgccggtcgcaagccggaaatcagcgcagatggcttgtcgatggaccgctatcaaggccgtccggcagacaccggtggcgcgttacgtccggcaccggcattgcggagcaaccaagcgtga

SEQ ID NO: 598 - protein, 438 aa, Unknown
  Obtained from environmental sample
  SIGNAL (1)...(20)
  DOMAIN (2)...(398): FAD dependent oxidoreductase
  SITE (378)...(381): N-glycosylation site. Prosite id = PS00001
MKVLVLGGGVIGVSSAYFLAKAGCDVTVIERQPGVALETSFANAGQISPGYAAPWAAPGIPTKAVKWLFQKHAPLAIRPDGTLHQLKWMAQMFANCNEKRYHVNKGRMMRLAEYSRDVIRTLRAETGIKYEGRSLGTLQIFRSQAQVDGAAKDIAVLQECGVPFEVLDRDGCARAEPALAQVKHKIAGGLRLPNDETGDCQLFTMRLADMAKALGVTFRFDTEIDDILFDGRRINGVRIGEEIVRADHYVMALGSYSPIIGRKLGLDLPVYPVKGYSLTIPVLDETRTPVSTILDETYKIALTRFDNRIRVGGMAELSGYDLRLNPKRRATLEMVVNDLFPGGGDVPAASFWTGLRPMTPDGTPLVGATPIANLSLNTGHGTLGWTMACGSGKLLADLIAGRKPEISADGLSMDRYQGRPADTGGALRPAPALRSNQA

SEQ ID NO: 599 - DNA, 1251 bp, Unknown
  Obtained from environmental sample
atgaaagtcatcgttctcggagccggcgtcgtcggcgtaacgtccgcctatcaactggccaaggccggccatgacgtgacggtcatcgaccggcaggaaggcccggcactggaaaccagctttgccaatgccggcgaagtttccttcggctattgctcgccctgggcggcgcccggcattccggtcaaggccatgaaatggctgttcatggaacatgcgccgctgatcctgcgtccgaagatggatgcggcgatgctgtcctggatgctgaagatgctgatgaactgcactgcggagcgctatgcggtcaacaagagccgcatgctgcggcttgccgactatgcccgcgtctcgctggccgaggtccgctcggaaaccgggattgcctatgacgagcggatgcagggaacgctgcagctgttccgcaagcagcagcagctcgatgcatccgcatccgacgtcaaggcgctggcggcagacggcattccctatgaagtgctcgatccggaaggctgcattcgcgtcgagccggcgctcaagcatgtccgccacaagatcgtcggcggccttttgacgccaaaggacgagacgggcgattgcttcaagttcaccaatgcgctggcgctgaaggcagtggaactgggcgtaaaatttgtctggggcaccaatatcaaggcgctggatgtcgagggcgggcagatccgcggcgtggtcaccgacaagcagacgctgcgctctgacgccgtcgtcatcgcgctcggcagctattcgccgatgctggcaaagcaggtcggcatcaagctgccggtctatccggtcaagggctattcgctgacgatcccgatcaccgatgcatcgcgtgcgccggaatcgaccgtcatggacgagacctacaagatcgccatcacccgtctcggcgaccgtatccgcgtcggcggcatggcggaaatttctggctataccaacgatctcggtcccaagcgccgggcgacgctggagcattccgtcaccgatcttttccccggcggtgatgtgaaaaaggccgagttctggtcgggcctgcggccgatgacgccggacggcacgccggtgatcggtgccaccaaggtgaagggcctgttcctcaataccggccacggtacgctcggatggacgatgagctgcggctcggcaaaggtcatcagtgccatcgtcagcggcaagaagccggaaatcgacgccacggacctcgccgtctcccgctacgcctga

SEQ ID NO: 600 - protein, 416 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKVIVLGAGVVGVTSAYQLAKAGHDVTVIDRQEGPALETSFANAGEVSFGYCSPWAAPGIPVKAMKWLFMEHAPLILRPKMDAAMLSWMLKMLMNCTAERYAVNKSRMLRLADYARVSLAEVRSETGIAYDERMQGTLQLFRKQQQLDASASDVKALAADGIPYEVLDPEGCIRVEPALKHVRHKIVGGLLTPKDETGDCFKFTNALALKAVELGVKFVWGTNIKALDVEGGQIRGVVTDKQTLRSDAVVIALGSYSPMLAKQVGIKLPVYPVKGYSLTIPITDASRAPESTVMDETYKIAITRLGDRIRVGGMAEISGYTNDLGPKRRATLEHSVTDLFPGGDVKKAEFWSGLRPMTPDGTPVIGATKVKGLFLNTGHGTLGWTMSCGSAKVISAIVSGKKPEIDATDLAVSRYA

SEQ ID NO: 601 - DNA, 1254 bp, Unknown
  Obtained from environmental sample
atgaagatcaccattctcggcgcaggcgtcatcggcgtcacatccgcctattatctcgccaaggccggccacgaggtgaccgtcgtcgatcgccagccgggcccggcgctggaaacgagttttgccaatgccggcgaggtttccttcggttactgctcgccctgggctgcgcctggcattccgcagaaggcgctaaagtggatcttcatggagcacgcgccgctgatcctgaggccgaagctcgatggtccgatgctctcctggatgctgaaaatgctgatgaactgcacctcggagcgctatgccatcaacaagagtcgtatgctgcggcttgccgattacagccgcctcgcgctcgccgaggtgcgcgccgaaaccaatgtggactacgaccagcgcatgcagggaacgctgcagctcttccggaccgaagcccaactcgaagcctctgccaaggacgtgaaggcgctcgccgccgatggtattcctttcgaagtgctcgatccggaaggctgcatccgcgtcgagcccgcactcgcccatgtccgccacaagatcgtcggcggcctcctcacccccaaggatgaaaccggcgactgcttcaagttcaccaatatccttgcagaaaaggccaccggcatgggtgtccgtttcgaatggggcgtcaacatcaaggggctcgacgtccagggcggcgaagcgaagggcgtcgtgaccgatcgcggcacgatcgcgtcggatgccgtggtcgtggcactcggcagctattcaccgctccttgtcaagccgcacggcatcaacctgccggtctatccggtgaagggctactcgctgacgatcccgatcaccgatgcctcgcgcgcgccggaatcgactgtcatggacgaaacctacaagatcgcgatcacccgtctcggcgaccgtatccgcgtcggcggcatggcggaaatctccggctacaccaatgatcttggcgaagcgcgccgccggacgctggaacattccgtcaccgaccttttcccgggcggcgatgtctcgaaggccaatttctggtcgggccttcgcccgatgacgccggacgggacgccggtgatcggcgccaccaaggtccgcaacctctatctcaacaccggccacggcacgcttggctggaccatgagctgcggttcggccaaggtgctggccgatatcgtcagcggcagacaagccgatatcgagacgaaggatctggcgatcagccgttacgcggcctga

SEQ ID NO: 602 - protein, 417 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKITILGAGVIGVTSAYYLAKAGHEVTVVDRQPGPALETSFANAGEVSFGYCSPWAAPGIPQKALKWIFMEHAPLILRPKLDGPMLSWMLKMLMNCTSERYAINKSRMLRLADYSRLALAEVRAETNVDYDQRMQGTLQLFRTEAQLEASAKDVKALAADGIPFEVLDPEGCIRVEPALAHVRHKIVGGLLTPKDETGDCFKFTNILAEKATGMGVRFEWGVNIKGLDVQGGEAKGVVTDRGTIASDAVVVALGSYSPLLVKPHGINLPVYPVKGYSLTIPITDASRAPESTVMDETYKIAITRLGDRIRVGGMAEISGYTNDLGEARRRTLEHSVTDLFPGGDVSKANFWSGLRPMTPDGTPVIGATKVRNLYLNTGHGTLGWTMSCGSAKVLADIVSGRQADIETKDLAISRYAA

SEQ ID NO: 603 - DNA, 1254 bp, Unknown
  Obtained from environmental sample
atgaaaagagtaattgtaattggaagtggcgctttgggactatgcagcgcttattttcttcaaaaagaaggatgtagagtacaggtgatcagcgcctcaaaaaaaggcgaagcagaaggctgttcatatggaaatgcgggaatgatcgtgccaagtcatctaagccctttagcggctccgggtgtaatacgaaaagggctaaaatggttactggatcctcaaagtccactatatattaaacctcgtttaaatgctgatctgatgtcatggttatggcattttataaaatcgtcgaatgaaaaaaatgttcagcaagccggacctttattattagagatgaacctggcaagtcgcgatctttttaaatctatttcagaaagtgaagcactaaattatcagtatcagcgaggtggtttaatgatgctatacaaaacaagtgcttttcaggatgaagaagagcatctggccgaaatagggagggaatatggattggaaatagacgtcttgaattcggctcagctccgaaatcatgaggaaaagctggaagcggatgttttgggtggggtgtggtataaaagcgacgcccacattattccccaaagttttatggaagaaatgactgacttactttttaaaagaggagttcagttcgaatatgataaaagaatcgattccattgtgaaagaaaatggaagaataaaagccatcagatcgcttgaagaagaatttgaagcagatgaatatattatttgttcgggaagctggagtcaggaaatggtaaaggcacttcaaatcaatcttcctattcaggctggaaaaggctaccatcttcatattccatcagttcccctgcaacttaaaacgccttccatattgtgcgaagcgaaagtagcgatgacgccgatgttgaatgatcttcgaatttccggaacgatggaatttgccggtttggatctgaagatcaataataatagggtagaggggataaaaaacagcgtcggcaagtatttcaaaaaatttgataagaatttatttaatggcataagtccctgggcaggattaagacctgtatctcctgatggcctgccttatatgggaagaagtgaaagcatttctaatctcagttttaatacaggacatgccatgatgggcttaagtttagctccaatcagcggaaaattgatcagtgacttgatcaccaaaggaacatgcgaaatgaatatcgatatcttatctccggatcgatttaagtaa

SEQ ID NO: 604 - protein, 417 aa, Unknown
  Obtained from environmental sample
  DOMAIN (3)...(398): FAD dependent oxidoreductase
  SITE (378)...(381): N-glycosylation site. Prosite id = PS00001
MKRVIVIGSGALGLCSAYFLQKEGCRVQVISASKKGEAEGCSYGNAGMIVPSHLSPLAAPGVIRKGLKWLLDPQSPLYIKPRLNADLMSWLWHFIKSSNEKNVQQAGPLLLEMNLASRDLFKSISESEALNYQYQRGGLMMLYKTSAFQDEEEHLAEIGREYGLEIDVLNSAQLRNHEEKLEADVLGGVWYKSDAHIIPQSFMEEMTDLLFKRGVQFEYDKRIDSIVKENGRIKAIRSLEEEFEADEYIICSGSWSQEMVKALQINLPIQAGKGYHLHIPSVPLQLKTPSILCEAKVAMTPMLNDLRISGTMEFAGLDLKINNNRVEGIKNSVGKYFKKFDKNLFNGISPWAGLRPVSPDGLPYMGRSESISNLSFNTGHAMMGLSLAPISGKLISDLITKGTCEMNIDILSPDRFK

SEQ ID NO: 605 - DNA, 1254 bp, Unknown
  Obtained from environmental sample
atgtcagcagatgtgatcgtcctcggcgccggtatcatcggtgtctccacagccatccatctggcccggcgcggcaagagtgtggttctggtcgacagacggggcgccggcgaggaaacatcgttcggcaatgccggtctgatccagcgcgaaggcgtcgtgccctacggctttccccagcagctgcggctgatcgcccgctatgcgctcaacaacaatatcgatgcccattaccactggtcggccatgccgaagctcgcctcgttcctggcgcaatactggtggcattccaacaccaagcgccaccaggcgatcgccagggcctacgcgccgctgatcgagaattccatttccgagcatgacgacctgatcaaggcgtccggcgccggaaatctgatttcgaaaaggggctggctcgaggttttccgcacctctgccgtgcgcgacgcagaatatgccgaagccgaacggctcagccgcgaatgcggcatccatttcaccgcgctgtcggccaacgacgtcggccaggcggagccgcacctcaccggcgatttttccggcgggctgaaatgggaagatccatggtcggtgttcgacccgcacgggctgacgatcgcctatcttcgcctgtttgagagcctcggcggccgtttcgtcaagggcgacgccaccaggatcgcccagcgatccaccggcaagggctggcagatcgacacggccgagggcaagatcgaagccgccgaagtcgtggtcgcgctcggcccctggtccgacatggtcaccaagcctctcggctatcgcttcccgctcggcgtcaagcgcggctatcacatgcattacggcacagacgagggtgtgcggctcaacaactggaccatggacaaggagcgcggctatttcctggcgccgatggtcaacggcatccggctcaccaccggcgccgaattcgcgtcccgcgacgcgccgaagacgccggtgcaggttgaccgggccgaaaaggtcgcccgcaagatcttcccgctcggtgaacggctcgacgccgaaccgtggatggggtcccgcccctgcacgcccgacatgatgccgatcatcggccgggcaccgcgccacgacggcctgtggttcgccttcggccacgcccatcacggcttgacgctcgggccggtcaccggacgcatcctcgccgaggccatgaccggcgaaaagaccttcatcgatgccacgccttaccggccggagcgcttccggccgtaa

SEQ ID NO: 606 - protein, 417 aa, Unknown
  Obtained from environmental sample
  DOMAIN (4)...(397): FAD dependent oxidoreductase
  SITE (294)...(297): N-glycosylation site. Prosite id = PS00001
MSADVIVLGAGIIGVSTAIHLARRGKSVVLVDRRGAGEETSFGNAGLIQREGVVPYGFPQQLRLIARYALNNNIDAHYHWSAMPKLASFLAQYWWHSNTKRHQAIARAYAPLIENSISEHDDLIKASGAGNLISKRGWLEVFRTSAVRDAEYAEAERLSRECGIHFTALSANDVGQAEPHLTGDFSGGLKWEDPWSVFDPHGLTIAYLRLFESLGGRFVKGDATRIAQRSTGKGWQIDTAEGKIEAAEVVVALGPWSDMVTKPLGYRFPLGVKRGYHMHYGTDEGVRLNNWTMDKERGYFLAPMVNGIRLTTGAEFASRDAPKTPVQVDRAEKVARKIFPLGERLDAEPWMGSRPCTPDMMPIIGRAPRHDGLWFAFGHAHHGLTLGPVTGRILAEAMTGEKTFIDATPYRPERFRP

SEQ ID NO: 607 - DNA, 1251 bp, Unknown
  Obtained from environmental sample
atgaaagtcctggttcttggagccggtgtggtgggcgtgaccagcgcctggtatctcgcggaagacggccacgaggtgacggtcgtcgaccgccagcccggcgccgggctggagacgagcttcgcgaacggcggccaggtctcggtgagccaggccgagccgtggtccaaccccggcgcgccggcgaagatcctcaagtggctgggcgacgaggaggcgccgctgctgttccggccgacggcgagcgcacggcagtgggcgtggggcgcgcgcttcttctacgagtgcctgcctggacgcacgcgcgagaacaccctgcagatcctgcgcctcgcgatctacagcggggcacagctcaagctgctgcgcgagcggaccggcatccgctacgacgggctgcagcgtggtctgctgcagatcaactactcggcgcaggacttcgagcacgccaaggcgcgcgcggcgctgctcggcagccacgggctggggctgcaggtgctgaacgcgcaggagtgcctggcgctcgagccagcgcttggctacagcaaggtcaagccggtcggcgggacctacgcgccgtccgacgagtccggcgacgcgcatctgttcacccacaacctcgcgcagctctgcgtgcagcgcggagtgcagatgcgctatgacgtcacggtcgagcggctggaagcacgcgacggcaaagtcacgggcgcagtcgcacgcctggcgggcggcgctcccgagctcatgcaggccgacgccgtgctcgtctgcctgggcacctggaccccgtttctcctcgagccgctcggggtgcgggcgccgatctatcccgtcaagggctactcgatcaccgtccccgtcgtgcgtccggagcaggcgccgagcgtgtgcctgaccgacgaggggcacaagctcgccatctcccggctcggcgaccggctgcgggtggccgggacggccgagctcaacggctacgacaccacgatcagcgagcggcgctgcaacgcactgatcgaacgcgccaaggtgctcttccccgacgcggtggacttcacgcgtgcacagcgatgggccgggctgcggccggcgacgcccggcaatgtccccgtgatcggcggcacgcgctggcccaacctcttcgtcaacgccgggcacggtacgctcggatggacgctgtgcgccggctcgggccgggcgatcgcggacatcgtcggcgggcgccggccgcaggtggatttccgcttccgctag

SEQ ID NO: 608 - protein, 416 aa, Unknown
  Obtained from environmental sample
  DOMAIN (2)...(403): FAD dependent oxidoreductase
  SITE (143)...(146): N-glycosylation site. Prosite id = PS00001
MKVLVLGAGVVGVTSAWYLAEDGHEVTVVDRQPGAGLETSFANGGQVSVSQAEPWSNPGAPAKILKWLGDEEAPLLFRPTASARQWAWGARFFYECLPGRTRENTLQILRLAIYSGAQLKLLRERTGIRYDGLQRGLLQINYSAQDFEHAKARAALLGSHGLGLQVLNAQECLALEPALGYSKVKPVGGTYAPSDESGDAHLFTHNLAQLCVQRGVQMRYDVTVERLEARDGKVTGAVARLAGGAPELMQADAVLVCLGTWTPFLLEPLGVRAPIYPVKGYSITVPVVRPEQAPSVCLTDEGHKLAISRLGDRLRVAGTAELNGYDTTISERRCNALIERAKVLFPDAVDFTRAQRWAGLRPATPGNVPVIGGTRWPNLFVNAGHGTLGWTLCAGSGRAIADIVGGRRPQVDFRFR

SEQ ID NO: 609 - DNA, 1233 bp, Unknown
  Obtained from environmental sample
gtgaaagtcgatgcggtcgtcctcggcgccggaatggtgggcatcccggtcgcgctgcacctgcaggcgcgcgggcgctcggtggtgctcgtggaccggcgcggcgcggccgaggagacgtccttcggcaatgcgggcctcatccagcgcgagggcgtgtacccctacggtttcccgcacgacttcggcgcgctgctgcgctacggcttcaaccggacgatcgacgcgcactaccaccccacggcgctgttcgacctcgcgcccttcctctggaagtactggcatcactcgcgcccggcgcgccacgccgagatcgcgcgcctctacgcgaagctgatcgagcgctgcgtggcggagcacgacgcgctcgcgcagcaggcgggcgcaacggacctcctgcggcgcaagggctggatgcgcgtatttcgcaccgagcgcgaacgggacgtgcgcatcgcggaagcgaagaaatggcgggcggagtttggcattgcttttgaatctctcgataaaaaagcactgcgggacaaggaaccccacctggccccggtcctcgtgggcgcgctgcactggaccgacccggtgagcgtcatcgatccgcagggtcttgcgctcgcgtacctgaagctgttcgaaagccggggcgggcgattcctgcagggcaatgccctctcgctggagcaaggctggaaagtccagacggttgaaggcacggtcgaggcaggcacggtcgtcgtctgtctcggtccctgggccgacctcgtgacgaaaaagctcggctacgacctgccgctcgccgtgaagcgcggctaccacatgcattaccgcgccgcaggcaaggcgatgctcaaccaccccatcctcgacaccgagcgcggctacctgatcgcgccgatgaagcgcggtatccggctcaccacgggcgcggagttcgcgctgcgcgacgcgatccgcacgccggtgcagctcgggcgcgccgagcccatcgcccgcgacctgttcccgctcgccgagcgcctcgacaccgaggcctggatgggcgcgcggccctgcaccccggacatgatgcccatcatcggtcctgcgccgcggcacaaggatctctggttcgcgttcggccacgcgcaccacggcctcacgctcggtcccgtgacaggtcgcctcatcggagagatggtcgccggcgagacgccgttcaccgatccggcgccctaccgcgcggatcgcttctga

SEQ ID NO: 610 - protein, 410 aa, Unknown
  Obtained from environmental sample
  DOMAIN (4)...(392): FAD dependent oxidoreductase
  SITE (72)...(75): N-glycosylation site. Prosite id = PS00001
MKVDAVVLGAGMVGIPVALHLQARGRSVVLVDRRGAAEETSFGNAGLIQREGVYPYGFPHDFGALLRYGFNRTIDAHYHPTALFDLAPFLWKYWHHSRPARHAEIARLYAKLIERCVAEHDALAQQAGATDLLRRKGWMRVFRTERERDVRIAEAKKWRAEFGIAFESLDKKALRDKEPHLAPVLVGALHWTDPVSVIDPQGLALAYLKLFESRGGRFLQGNALSLEQGWKVQTVEGTVEAGTVVVCLGPWADLVTKKLGYDLPLAVKRGYHMHYRAAGKAMLNHPILDTERGYLIAPMKRGIRLTTGAEFALRDAIRTPVQLGRAEPIARDLFPLAERLDTEAWMGARPCTPDMMPIIGPAPRHKDLWFAFGHAHHGLTLGPVTGRLIGEMVAGETPFTDPAPYRADRF

SEQ ID NO: 611 - DNA, 1254 bp, Unknown; identical to SEQ ID NO: 579
  Obtained from environmental sample

SEQ ID NO: 612 - protein, 417 aa, Unknown; identical to SEQ ID NO: 580
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001

SEQ ID NO: 613 - DNA, 1287 bp, Unknown
  Obtained from environmental sample
atgaagatcaccatcatcggagcaggcattgctggcgtcagtaccgcctgggcactgacgcaggccgggcacgaggttagagtggtcgagcgcaaaggtgccgctgccatggaaacgagttatgccaatgcgggtcaattggcctacggtgccatagcaccctgggcgtcgatgtcgatgattcgctccagcctgaaaaccttgctgaagcctgccggtgcgttaaaacttcccctgttcccatccctgttgacctggcatttcatgatcaccatgggccgctttgcgctgaaaaagcgattgtttgaaaccaattggcaggccatgttggacctggggcaattcagtaaagaggccttgcgtgagctggaatcggaactctctctgaagtacgacggccatcataacggaatgttgaaactggctagcacggcagcagaaaagcaggaactgatgggcgtcgccgccatgctggcgcgttgcgagatccgccatcaatggctctctgctcaggaggcgatggatacagagcccggcctgaatgccgaagcgcccttgctgggtgggttgcacttgcctggcgatggcagtggcgattgccatcgtttcagcgttgaattggccagggcctgtgagcaggctggtgtggtctttgattacgacagtgaagtgctcagcctgcgtaccagtacggacagtctggaggccatttatgtgcggcagcacggtaaggaagactggctggagtcggatgcctttgtgttctgcacgggctgtgcgagtcgggagttcggcttatcactcggcttgaagttgcccatttatccggtcaaggggtattcgattaccttgccagttaccgcacctgagcgggcaccggtctcggctgtcatagacgatcgttaccgcctggccatcacccgccttggcaagcgagtgcgtgtgacaggctttgccgagctggtcgataacgataaaactttgccagacaagcggttgtctgtactgcgcgagggtttcgatttccgctttccgggctcggtggattggtcggaagccgaaccctgggcgggcttccgacccatgacgccggacggcccgccagccattggccagggcatgcaggacaatgtctggttcaataccggacacggcacctggggctggaccatggcggccggtagcgccgctctactcagtcagcaaattgccggttcaccaccagacttcaacaccagacccttcgatccgactcgcttttctcggaaggggtggttcaagggctga

SEQ ID NO: 614 - protein, 428 aa, Unknown
  Obtained from environmental sample
  SIGNAL (1)...(18)
  DOMAIN (2)...(402): FAD dependent oxidoreductase
MKITIIGAGIAGVSTAWALTQAGHEVRVVERKGAAAMETSYANAGQLAYGAIAPWASMSMIRSSLKTLLKPAGALKLPLFPSLLTWHFMITMGRFALKKRLFETNWQAMLDLGQFSKEALRELESELSLKYDGHHNGMLKLASTAAEKQELMGVAAMLARCEIRHQWLSAQEAMDTEPGLNAEAPLLGGLHLPGDGSGDCHRFSVELARACEQAGVVFDYDSEVLSLRTSTDSLEAIYVRQHGKEDWLESDAFVFCTGCASREFGLSLGLKLPIYPVKGYSITLPVTAPERAPVSAVIDDRYRLAITRLGKRVRVTGFAELVDNDKTLPDKRLSVLREGFDFRFPGSVDWSEAEPWAGFRPMTPDGPPAIGQGMQDNVWFNTGHGTWGWTMAAGSAALLSQQIAGSPPDFNTRPFDPTRFSRKGWFKG

SEQ ID NO: 615 - DNA, 1248 bp, Unknown
  Obtained from environmental sample
atgacaaaggacgcaatcgttctcggcgcaggcatcgtcggtgtttcgacggcaatccatctgcagcggcggggacggcaagtcgtcctcgtcgatcggcagccaccgggccgtgggacctcgttcggcaatgccggcctcatccagcgcgagggcgtggtgccctatggctttcctcagcaattcggcctgctgctgcgctatgccttcaacaaccgcatcgacgcacattaccatctgcgcgccctgccggcgcagatcgcctttcttgcccgctattggtggaactccaataccaagcgccatgagatgatttcgcgtgcctatgcgccgctgatcgaacattccgtcagcgagcacaatgacctcatcgaagcctcgcacgccgaggagctcattcgcaagaacggctggatggagctgttccgctcgaacgagaagcgggatgccgagtttgccgaggcggagcgcctcaaccgcgaattcggcatcggctatgacgcgctgagcagcgcagatatcgcaagtgccgagccgcatctgagaggcagctttgctggagcacttcgctggcgcgatccctggtcggtgctggacccgcacggattgacggcggcctatcggcgatatttcgaaagcattggcggccgtgtgacgaccggggatgccgtctcgctcggcatggcaggttcggcgtggagaatggtgacggcggagggatcgatcgaggcggaggatgtcgtcgtcgcactcggcccgtgggctgatatcgtcacgaaacgcttcggctacgctttcccgctcggcgtcaagcgcggctaccacatgcattacgccgccgagggcaatgccgttctcaacaactggatgctggatgccgagcgcggctatctgctggcgccgatgagccgtggcattcgtctgacgaccggcgccgaattcgccctgcgcgatgcaccgaagacgccggtgcagctcgatcgcgcagaggccatcgcccgcgccgccttcccgctcggcgaacggctcgatccggaaccctggatgggtgcgcggccctgcacgcctgacatgatgccgattatcggcaaggcgccgcgccacaacggcctatggttcgccttcggccatgcccatcatggattgacgctcggcccggtgaccggccgcgtgcttgcagagctcatcaccggcgagacgccgttcatcgatatttcggcttatgctcctagcaggtttgcgccctaa

SEQ ID NO: 616 - protein, 415 aa, Unknown
  Obtained from environmental sample
  DOMAIN (4)...(395): FAD dependent oxidoreductase
MTKDAIVLGAGIVGVSTAIHLQRRGRQVVLVDRQPPGRGTSFGNAGLIQREGVVPYGFPQQFGLLLRYAFNNRIDAHYHLRALPAQIAFLARYWWNSNTKRHEMISRAYAPLIEHSVSEHNDLIEASHAEELIRKNGWMELFRSNEKRDAEFAEAERLNREFGIGYDALSSADIASAEPHLRGSFAGALRWRDPWSVLDPHGLTAAYRRYFESIGGRVTTGDAVSLGMAGSAWRMVTAEGSIEAEDVVVALGPWADIVTKRFGYAFPLGVKRGYHMHYAAEGNAVLNNWMLDAERGYLLAPMSRGIRLTTGAEFALRDAPKTPVQLDRAEAIARAAFPLGERLDPEPWMGARPCTPDMMPIIGKAPRHNGLWFAFGHAHHGLTLGPVTGRVLAELITGETPFIDISAYAPSRFAP

SEQ ID NO: 617 - DNA, 1245 bp, Unknown
  Obtained from environmental sample
atggcacgcactgacgtaatcgttctcggcgccggtattgtcggcacttcgatcgcgctgcaactcgtcaagcgcaatatgagcgtcgcgctggtggagcgcgcgggcctcggcgagcagacgtcctacggcaattcgggcgtgatcgaaggctcgaccatcatgccgccggcctttccgagcgatatcggcgcggtgctgcgagtggcgctcaagcaggcgagcgacgccaactatcatcttagcttcttgccctgggcagcgccgtggctgctagcgttccgcgcggcctcgcagcccaaaaccatcgagcagaccgcgcgcatcaaccggcccctgttcgcccgcgctgtggccgagcacgaagagctgatgctcgaatccggcgccacccagcttctgcgccgcgacggctggatcaaactctatcgcaccgatgcggcctttgccggcatcgccaaggatctcgaactcgcgcgggaattcggcgtgccgttcaagacactcgatcccgaaggcgcgcgcaatcttgaaccgtcgctgtttccggtattcaagcacgcagtgcattggccggcgtcgccgaccttgagcgatccgctggccctgacgaaggcctatgccgcgcgcttcggcaccttgggcggcataacgctcaatggcgacgccttcacgctgcatcgttcgggcagcaattggcgcgtcgaaaccgacgaagggccgatcgacgcagctcaagtcgtggtcgcgctcggtccgtgggcgatggatttgctgaagccgctcggcatcaagctgccgatgggtttcaagcgcggctatcaccgtcacttcaagaccgaggaaagcgcgccgctgtcgcggccggtggtcgatgtgcaatacggctatctgatcacgccgatgcggcagggcatccgcgtcacgaccggcgcggaattcgccgaccgcgatgcggctccgacgccggtgcagttcgatcgcttcatgccgaagctgaacgagctctacaaaatcggaccgcgcgccgaggatcgtacctggctcggctcgcgaccttcatttccggattcccggcccgtcatcggacgcgcgcctgggcaaaagggaatgtggctcgccatcggccacgcgcattgggggctcacgctgggtccggtcaccggacgtctgctcggcgagatgatggcgggggaaacgccgtttctcgatcccaagggcttcgccgccgaacgcttcatgtaa

SEQ ID NO: 618 - protein, 414 aa, Unknown
  Obtained from environmental sample
  DOMAIN (5)...(395): FAD dependent oxidoreductase
  SITE (26)...(29): N-glycosylation site. Prosite id = PS00001
MARTDVIVLGAGIVGTSIALQLVKRNMSVALVERAGLGEQTSYGNSGVIEGSTIMPPAFPSDIGAVLRVALKQASDANYHLSFLPWAAPWLLAFRAASQPKTIEQTARINRPLFARAVAEHEELMLESGATQLLRRDGWIKLYRTDAAFAGIAKDLELAREFGVPFKTLDPEGARNLEPSLFPVFKHAVHWPASPTLSDPLALTKAYAARFGTLGGITLNGDAFTLHRSGSNWRVETDEGPIDAAQVVVALGPWAMDLLKPLGIKLPMGFKRGYHRHFKTEESAPLSRPVVDVQYGYLITPMRQGIRVTTGAEFADRDAAPTPVQFDRFMPKLNELYKIGPRAEDRTWLGSRPSFPDSRPVIGRAPGQKGMWLAIGHAHWGLTLGPVTGRLLGEMMAGETPFLDPKGFAAERFM

SEQ ID NO: 619 - DNA, 1593 bp, Unknown
  Obtained from environmental sample
atgaaaccagacggcggttccctgattggcttcggttccagcggcacgggcggcgcttccttcaaggcgttcgatccggccaagaacacggcgttggagccgtcgtttctctcggcgacgtccgccgacgtcgaccgcgcggtcgaactcgccgtcgccgccgcgccggtgctcgcccggctttccggcgcgggccgcgcgaagttcatgcgcgccatcgccgccaacctcgaggccaaggccgacgatctcgtcgcccgcgccatgcaggaagccgcgctgcccgaagcccgcctgaagggcgaggtggcgcgcaccgtcggccagctgcgcctgtatggcgaagcggcggagaaggggacttggatcgatgcgcgcatcgagacggcgcagcccgaccgcaagccgctgccgaaacccgatcatcgttcgctcctgcgtccgctcggcccggtggtcgtgttcggttccagtaatttcccgttcgcttactccgtcgcgggcggcgacaccgcttccgccttcgccgccggctgcccggtgatcgtcaaggcgcacccggcgcatccgggtacgagcgaaatgactggacgcctgatcctgcacgcggtgcgcgattgcggcctgcccgagggcacgttctcactcctgttcgatggtggcttcgaaatcggtcaggcgctcgtgaagcatccggcgatcaaggccgcgggcttcaccggctcggtcaagggcggtcgcgcgctcaccgatctcggtgccgcgcgtccggaaccgattccggtttacgccgaaatgggcagcgtgaaccccgtgttcatcctgcccggcgcgctggcggaacgttccgcggccatcgtcgacggcctgcatgcttccggcacgctcggcgtcggccaattctgcaccaatccgggcttgatcgtcctgcagcgctcgccggccgccgaggaattcgtgaaggcgctggtcgccaagctcaatgtcacgcccgaaggcatcatgctgacgcccggcatcgccaaggcctacgccaccaacaccgcccagcgcgcgaagcagccgggcgtgaagttgctcgcgcaggcgccggcgcaggccgcgtgcggcgtggcgccgatctggttcgaaaccgacgccctgagcttcctcggcaatcatttgctggccgaggaaatcttcggcccgagtgcgttggtcgtctggtgcaaggatcgcgccgagatgctccaagttgcggccaatgtggaaggttcgcttaccgcgacgctgcaagtcggcgcggcggaggcgaaggaccagaccgatctcatcgaattgctcgccaccaaggccgggcgcctcgtgctcaacggctatccgaccggcgtcgaagtcagccacgcgatcgtgcacggcgggccgtatccctcgacgagcgacggcggccgcaccacctcggtcggcacccgcgcgatcggccgttgggcgcgtccgatctgctaccagagcttcctcgacgagttgctgccggcggaattgcagaatgcgaatccgttgaagctcacccggctcgtgaacggcctcgccaccgaccaggcgatttcatcgtaa

SEQ ID NO: 620 - protein, 530 aa, Unknown
  Obtained from environmental sample
  DOMAIN (11)...(481): Aldehyde dehydrogenase family
MKPDGGSLIGFGSSGTGGASFKAFDPAKNTALEPSFLSATSADVDRAVELAVAAAPVLARLSGAGRAKFMRAIAANLEAKADDLVARAMQEAALPEARLKGEVARTVGQLRLYGEAAEKGTWIDARIETAQPDRKPLPKPDHRSLLRPLGPVVVFGSSNFPFAYSVAGGDTASAFAAGCPVIVKAHPAHPGTSEMTGRLILHAVRDCGLPEGTFSLLFDGGFEIGQALVKHPAIKAAGFTGSVKGGRALTDLGAARPEPIPVYAEMGSVNPVFILPGALAERSAAIVDGLHASGTLGVGQFCTNPGLIVLQRSPAAEEFVKALVAKLNVTPEGIMLTPGIAKAYATNTAQRAKQPGVKLLAQAPAQAACGVAPIWFETDALSFLGNHLLAEEIFGPSALVVWCKDRAEMLQVAANVEGSLTATLQVGAAEAKDQTDLIELLATKAGRLVLNGYPTGVEVSHAIVHGGPYPSTSDGGRTTSVGTRAIGRWARPICYQSFLDELLPAELQNANPLKLTRLVNGLATDQAISS

SEQ ID NO: 621 - DNA, 1266 bp, Unknown
  Obtained from environmental sample
atgagaacctccaagtccgtcatcgtctgcggcggcggcatcgtcggcctttgcactgcgtattatctcgcgcgcgaaggctgcgaagtgaccgtcgtcgagcgccacgccgagaacgcgcacgaccattgcgcgctgggctccgccggctacgtctcgccgagccacgtcatcccgctggccgcgcccggcatggtctggaagggcctcaagtggatgacgaactcgcgcagcccgttctacatccagccccggctcgactccgatctgatgcgctggggctggcatttctggcgcgcgagcagccagcgtcgcgtcgagcgtgccgccccgatcctgcgcgacctgtgcctgatggcgcgccagctttacgaggaactcgacgatctcaccggcgaccgttccgacttccggaaggacggcctgctcaatctttgccagaccgaggcgggcttcgagcacgaggtgcacggtctggccaagctggcgaacgagctcggcgtcgaagcgcaagtgctggacgcgcagcagaccgccgcgctcggtttgggggtgaaggtcaacatcatcggttcggttttctttccgatcgatgcgcacctgacgccggcgcgcttttgtccggcgctgaccgcgctgctcaaggagatgggcgtgcgcttccgtttcagcacgacgatctacggctggcgcacggaagggcggcggctggcggcggtgcagacgacggccggcgatttgatcgccgacgaatttgtcctaaccggcggctcgtggtcgccgggcatgatctccgcgctcggcgcgcgtctgccgatgcaggcgggcaagggctacagcctcacggtgcagcggccgcgcctgcgcgcgaccaagccgatgatcctcgtcgaacgccgcgtggcgctgacgccgatgggcgagacgatgcgttttggcggcacgatggagattgcgggccacaacgatcgcatgcgcccggagcgactggaacagatcaaggccggcgcgatggcgttcctgccggagctgacgcccgatgacttcgccgaggcacggccgtggtttggctatcgtccggtgacgccggacgggttgccatacatcgggcgctttgggcgctggaccaatcttaccgccgcgtgcggccacgcgatgctgggcgtcacgctcgccccgaccaccggccgcctcgtggctgaggtgatcggtggcaagaagccgtcagtgaatctgacactgctcgatccgaatcggtacgcgtag

SEQ ID NO: 622 - protein, 421 aa, Unknown
  Obtained from environmental sample
  SIGNAL (1)...(24)
  DOMAIN (6)...(402): FAD dependent oxidoreductase
  SITE (382)...(385): N-glycosylation site. Prosite id = PS00001
  SITE (417)...(420): N-glycosylation site. Prosite id = PS00001
MRTSKSVIVCGGGIVGLCTAYYLAREGCEVTVVERHAENAHDHCALGSAGYVSPSHVIPLAAPGMVWKGLKWMTNSRSPFYIQPRLDSDLMRWGWHFWRASSQRRVERAAPILRDLCLMARQLYEELDDLTGDRSDFRKDGLLNLCQTEAGFEHEVHGLAKLANELGVEAQVLDAQQTAALGLGVKVNIIGSVFFPIDAHLTPARFCPALTALLKEMGVRFRFSTTIYGWRTEGRRLAAVQTTAGDLIADEFVLTGGSWSPGMISALGARLPMQAGKGYSLTVQRPRLRATKPMILVERRVALTPMGETMRFGGTMEIAGHNDRMRPERLEQIKAGAMAFLPELTPDDFAEARPWFGYRPVTPDGLPYIGRFGRWTNLTAACGHAMLGVTLAPTTGRLVAEVIGGKKPSVNLTLLDPNRYA

SEQ ID NO: 623 - DNA, 1260 bp, Unknown
  Obtained from environmental sample
atgcgcatcctgatcatcggggcgggcgtcattggcgttaccagtgcccattatctgcacaaggcagggcatgaggtcagcatccttgatgcagcacccgccgttgccgaaggggccagccacgccaatgccgggcagataagctggggctatgccagcccctgggcggcaccgggcattccattgaaggcgctgcgctggatgttcagcgcgcatccgcccttgctgatccatggttccaccgactggcggcaatggcgctggctgggctggatgctgcgaaactgcaccgccgaccgctatcgccgcaacaagacctggatgctgtcgctggcacgttacagccagcaggcattggccaccctgcgcgcggaaacgggcctgcgctatgatgacgggcagcgcggtacgctgcaattgttccgcgcgcataaggccatggaagcctcggcggctgacagccatgtgctgacggcgctgaacgtcccgcatgccctgctgacgccgcgtgaatgtgtgaaacgggaaccgggactggcgcatatggtggaccggttggccggcggtttgctgatgccgggggatgagacaggggattgccgcctgttcacccaggggctgagcgaccggttgcggcaggatggtgtcgccctgcatctgaacaccagcgtagcgcagattgtgcgcgacggggatcgggtcaccggcgtgatggcgggcgggcggtttcatgtagccgatgccgtggtgatcgccgccggccatgaaacagtacggctgctgcgaccgttggggttggatctgccggtgctgcccgtgaagggctattcggccactgtgcccatcgtggaagccgaccgtgcgcccgtttccacccttctggacgatcatcataagatcgccgtcacccgcctgggtgaccgtatccgggccgccggcattgcggaactggcggggccggatcaccggctgaccccggcacgctgcaacacggtgcgtcatgtgattgccgacctgttccccagagctgccgacatggcggcgatccagttctggacgggcctgcggcccatgacgcccaatggtgtgccactggtcggggaaagcggcgtaaaaggcctttaccttaacaccgggcacggcaccctgggctggaccatggcgtgcgggtcgggccggctgttggccgatatcatggaggggcacgtcacggatattgatgccgccccctatgcctggccccgcccgtttgccgaatga

SEQ ID NO: 624 - protein, 419 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MRILIIGAGVIGVTSAHYLHKAGHEVSILDAAPAVAEGASHANAGQISWGYASPWAAPGIPLKALRWMFSAHPPLLIHGSTDWRQWRWLGWMLRNCTADRYRRNKTWMLSLARYSQQALATLRAETGLRYDDGQRGTLQLFRAHKAMEASAADSHVLTALNVPHALLTPRECVKREPGLAHMVDRLAGGLLMPGDETGDCRLFTQGLSDRLRQDGVALHLNTSVAQIVRDGDRVTGVMAGGRFHVADAVVIAAGHETVRLLRPLGLDLPVLPVKGYSATVPIVEADRAPVSTLLDDHHKIAVTRLGDRIRAAGIAELAGPDHRLTPARCNTVRHVIADLFPRAADMAAIQFWTGLRPMTPNGVPLVGESGVKGLYLNTGHGTLGWTMACGSGRLLADIMEGHVTDIDAAPYAWPRPFAE

SEQ ID NO: 625 - DNA, 1254 bp, Flavobacterium sp. ATCC 27551
atgagggtcgccattctgggcagcggcgtcatcggcgtcacgtccgcctggtatctggcacaggccgggcatgaagtgacggtgatcgaccggcaggacgggccggcgctggaaaccagcttcgccaacgctggagaaatctcgcccggctatgcctccccctgggctgcgccggggataccgatgaaggcgctgcgctggctgttcatgaagcacgccccgctgatcctgcggccgcggatggacatggccatgctacgctggatggtggcgatgctgggcaattgcaacgaacgcgcctatgccatcaacaagagccggatggtgcgcctggccgaatatagccgtgaccggctgatcgacctgcggcgcgaaaccggcatcgcctatgacgagcggtcgcgaggcaccttgcagcttttccgcgagcagaagcagcttgacggcatcgcgaaggacattgccgtgctgaaggcggacggagtgcctttcgaagtgctggatgcggtaggctgcatcgcggcggaaccggggctggcaggcagcggcgtgcctctggccgggggcctgcggcttcccaatgacgaaaccggcgactgcttcaaattcaccaacgcgctggccgacatggcgaaggcgaagggcgtgaccttcctcaacggacggaccatcggaaggatcgccgtcgacaatggaaaggtcagccatgtcgaaaccgacaggggccatgtcgtggccgacgcctatcttgttgcgacgggcagctattccccgcagctgctggccccgctggggatcaggctgccggtctatccggtgaagggctattcgatcaccgttccgatcgtcgatgaggcaagggcgccggtgtcgaccctgctcgacgaaagctacaaggttgcgatcacgcggctgggcgaccgtattcgtgtgggcggcatggcggaactgtcgggctattccaaagggctgcccagggcgcggcgtgatacgctggaatattcggtgggttcgctctttccgggcgcaggcgatctgggcggcgccagcttctggtccgggctgcggccgatgacgccggacagcacgccggtcatcggggcgacgaaagtcccaaacctcttcctcaacaccgggcatggcacattggggtggaccatggcctgtgggtcggggcatgtgatcgcggacatcatcggcgggggcaggccccggatcgaaaccgccgatcttgcgatcagccgctattcataa

SEQ ID NO: 626 - protein, 417 aa, Flavobacterium sp. ATCC 27551
  DOMAIN (2)...(398): FAD dependent oxidoreductase
  SITE (105)...(108): N-glycosylation site. Prosite id = PS00001
  SITE (201)...(230): 2-oxo acid dehydrogenases acyltransferase component lipoyl binding site. Prosite id = PS00189
MRVAILGSGVIGVTSAWYLAQAGHEVTVIDRQDGPALETSFANAGEISPGYASPWAAPGIPMKALRWLFMKHAPLILRPRMDMAMLRWMVAMLGNCNERAYAINKSRMVRLAEYSRDRLIDLRRETGIAYDERSRGTLQLFREQKQLDGIAKDIAVLKADGVPFEVLDAVGCIAAEPGLAGSGVPLAGGLRLPNDETGDCFKFTNALADMAKAKGVTFLNGRTIGRIAVDNGKVSHVETDRGHVVADAYLVATGSYSPQLLAPLGIRLPVYPVKGYSITVPIVDEARAPVSTLLDESYKVAITRLGDRIRVGGMAELSGYSKGLPRARRDTLEYSVGSLFPGAGDLGGASFWSGLRPMTPDSTPVIGATKVPNLFLNTGHGTLGWTMACGSGHVIADIIGGGRPRIETADLAISRYS

SEQ ID NO: 627 - DNA, 1257 bp, Unknown
  Obtained from environmental sample
ttgaaagtcgtgatcctgggggccggcattaccggcgtgagttcggcgtggtttctacgcgaagcgggctttgatgtcacggtgatcgaccgtcagcccgaagccgcgctggaaacgagctttgccaacggcggccagatttccgtctcgcaatccgaaccctgggccaacccggatgcgccgctcaaggtgctcaagtggctctggcacgaagactctcccctgctgttccgcccccgtctcgatgcccgccaatgggcctggggcatgcgctttctgcgtgaatgcctgcctggtcgcaacgaacacaatatcgtgcagctggtgaacctggggctttacagccgcagcaccctcaaggccctgcgcgagagtaccggcatacagtacgaccacctcagccgcggcatcctgcagatcttcttcgaccagcagagcttcgacgctgccgccgagtcctctgccctgatgcggcgctataactgcttccgtgaggccatcccgcgcgagcgtgcggtcgagctggagcccgccctggcggtgctgggcagccgcctgaccggtgccatctgggccgaggatgacgaatcgggcgatgcccgcctctttacccagcaactggccaatctcgcggccgagcgcggggtggagttcctgttcaacacctgcatccgctccctgcaggctgagggcgggcagattaccggcgtgcgcgcctgcgacagcaatggcagtgccaccaccatacagggtgatgcctatttgatctgcctgggcagctatagcccgcaactgttggcgcccctgggcgtcaacctgccggtctaccccaccaagggatattcggccaccatgctgaccgatggctttgagggcgcgcctacggtcagcatcaccgacgacgccatgaagatggtctacacccggctgggtaaccgtatacggattgccggcacggccgagctggatggctacaacaccgaactgaacgatgtgcgttgcgaagccttgatccggcgctacttttcgctcttccccaattctgccgaccccaactcggtgcagtactggaccggcctgcgtccgtccactccctccaatgtgcccatcatcggccgctcgcaattgagcaatctgtatttcaacaccgggcacggcaccctgggctggaccgaaggccccggttcgggccgcgcgattgcggaaatcattgccgggcgtaagcccgaacttgagttcagctttgtcggtacctaa

SEQ ID NO: 628 - protein, 418 aa, Unknown
  Obtained from environmental sample
  DOMAIN (2)...(403): FAD dependent oxidoreductase
  SITE (246)...(249): N-glycosylation site. Prosite id = PS00001
MKVVILGAGITGVSSAWFLREAGFDVTVIDRQPEAALETSFANGGQISVSQSEPWANPDAPLKVLKWLWHEDSPLLFRPRLDARQWAWGMRFLRECLPGRNEHNIVQLVNLGLYSRSTLKALRESTGIQYDHLSRGILQIFFDQQSFDAAAESSALMRRYNCFREAIPRERAVELEPALAVLGSRLTGAIWAEDDESGDARLFTQQLANLAAERGVEFLFNTCIRSLQAEGGQITGVRACDSNGSATTIQGDAYLICLGSYSPQLLAPLGVNLPVYPTKGYSATMLTDGFEGAPTVSITDDAMKMVYTRLGNRIRIAGTAELDGYNTELNDVRCEALIRRYFSLFPNSADPNSVQYWTGLRPSTPSNVPIIGRSQLSNLYFNTGHGTLGWTEGPGSGRAIAEIIAGRKPELEFSFVGT

SEQ ID NO: 629 - DNA, 921 bp, Unknown
  Obtained from environmental sample
atggacatcggattcggggcgccagtggcgggcgcgtgggcgacgccacgcaacctcacggagttcgcgcggcgggcggaacggctgggctatcggtcgctgtggacgttccagcggctgctggtgccgcgggaggccgacatggcgcccgtctaccagagcgtgctcgacccgatggtggcgctcggctacgcggcggccgtgacgtccgtgatccggcttggggtcgcggtcatcaaccacccgttcgtctctcccgcgtacctggcgaagcaggcggccacggtggacgtgctctctggcgggcggctcgacctcggcatcgggatcggctggctgccccaggagttcaccgcctccggagccagcatggacaagcggggcccgcgcaccggggagtacctggccgcgatgcgcgcgctgtgggcggacgggaccagcgagttccacggcaggttccatgagatcccggcgggacggcaggacccgtctccggtgcagcgtcccggcccgccggtgctgcttggcgggatgtcgcggcaggcgatggagcgcgccgggcggatcgcggacggctgggtcaccgcgagcgccgccgacctgtccaaggtggcggagtccgcgcggatcgtgcaggaggccgccgcggcggccgggcgcggcccggtccggatcgtgtgccgtggtgtggtgcgggccggccagcaggtaaagtccccttcgggtgagcggatgctgctgtccggaagctacgcgcagatccgcgaggacaccgcgtggctggaaagctgcggggtgaccgaggtgttctacgacctgaactgggatccggcggtcgggaacccggccgctgacgagggtgccgcggtgctgcgagccgccgagatcctcgaggcgctcgccccggacggtgccctatga

SEQ ID NO: 630 - protein, 306 aa, Unknown
  Obtained from environmental sample
  DOMAIN (1)...(304): Luciferase-like monooxygenase
  SITE (18)...(21): N-glycosylation site. Prosite id = PS00001
MDIGFGAPVAGAWATPRNLTEFARRAERLGYRSLWTFQRLLVPREADMAPVYQSVLDPMVALGYAAAVTSVIRLGVAVINHPFVSPAYLAKQAATVDVLSGGRLDLGIGIGWLPQEFTASGASMDKRGPRTGEYLAAMRALWADGTSEFHGRFHEIPAGRQDPSPVQRPGPPVLLGGMSRQAMERAGRIADGWVTASAADLSKVAESARIVQEAAAAAGRGPVRIVCRGVVRAGQQVKSPSGERMLLSGSYAQIREDTAWLESCGVTEVFYDLNWDPAVGNPAADEGAAVLRAAEILEALAPDGAL

SEQ ID NO: 631 - DNA, 1233 bp, Unknown
  Obtained from environmental sample
atgagattcgataccgtggtgctcggcgccggcattgtcggggtgtgcgtcgccgtgcatctgcagaaacgcgggcggtcggtcgcgctgatcgaccgcaagctgccgggcaacgagacctcgttcggcaacgccgggctgatccagcgcgaaggcgtctatccgtacgcgtttccgcgcgggctcggcaccctgctgcgctacgcgcgcaaccagtcgcccgacgtgcgctatcacgccgacgcgatgctccacgtcgcgccgtttctttggcgctactggcgcaactcgcatccggcgaagcacgcggaaatcgcgaagtcgtacgcgacgctgatcgagcattgcgtcaacgaacatcgcgcgcttgccgccgacgccggtgcgagcgcgctgctgcggccgatcggctggatcaaggtgtttcgccacgccgccgcgcgcgacgccgaaacgacgctcgccgaacggtggcatcgcgaatacggcgtcgaattcgaaacgctcgacgcgccgcgcctgcaacaactcgaacccgatctcgacaaacgcctgcaaggcgggctgcgctatccgcaatccgattcggtcagcgatccgaacgcgctcgtcaccgcgtacgcgcggtacttcgaaacgctcggcggacggttcttcatcggcgatgccgacacgctgcgtgagggctggcaggtcgagacgcaggacggcgcgatcacggcgacgtcggcggtgatcgcgctcggaccgtggtcggatcgcgtgaccacgcggctcggatatcagctaccgcttgcggtcaagcgcgggtatcacatgcactacgcgccgcgccggaccgcgcggctcaatcatccgattctcgacgtcgaacacggctatgtgctcgcgccgatggcgcgcggcatccgcctgaccacgggcgccgagatcgcgcggcccgaggcggccaagacgccggtgcagctcgatgcggtcgagccgatcgcgcgcacgctgtttccgctcggtgaacggctcgacgcggaaccgtggatgggacgccgcccgtgcacgccggacatgatgccgatcatcgggcccgcgaacaaacatcagggactgtggttcgcgttcggccacgcgcatcatggtttgacgctcggaccggtgacagggcggctgatcgccgaaatgatgacgggcgaggagacgctggtcgatccacgaccgtttcgggtcgaacggttttag

SEQ ID NO: 632 - protein, 410 aa, Unknown
  Obtained from environmental sample
  DOMAIN (4)...(392): FAD dependent oxidoreductase
  SITE (38)...(41): N-glycosylation site. Prosite id = PS00001
MRFDTVVLGAGIVGVCVAVHLQKRGRSVALIDRKLPGNETSFGNAGLIQREGVYPYAFPRGLGTLLRYARNQSPDVRYHADAMLHVAPFLWRYWRNSHPAKHAEIAKSYATLIEHCVNEHRALAADAGASALLRPIGWIKVFRHAAARDAETTLAERWHREYGVEFETLDAPRLQQLEPDLDKRLQGGLRYPQSDSVSDPNALVTAYARYFETLGGRFFIGDADTLREGWQVETQDGAITATSAVIALGPWSDRVTTRLGYQLPLAVKRGYHMHYAPRRTARLNHPILDVEHGYVLAPMARGIRLTTGAEIARPEAAKTPVQLDAVEPIARTLFPLGERLDAEPWMGRRPCTPDMMPIIGPANKHQGLWFAFGHAHHGLTLGPVTGRLIAEMMTGEETLVDPRPFRVERF

SEQ ID NO: 633 - DNA, 1293 bp, Unknown
  Obtained from environmental sample
atgaaagtcattgttctcggcgccggcgtgatcggaaccaccacggcgtactacctcgccaaggccggcgcggaggtgacggtgatcgaccgccaaaacgcctgcgcgatggaaaccagcttcgccaatgccggccaggtatcgccgggctactccacgccctgggcagcgcccggcattccgctcaaggcggtgaagtggatgtttcagcgccatgcgccgctggcgattcgtccagacggcacgctgtggcaattgcgctggatggcgcaaatgttgcgcaactgcagcgctgaacgctatgcggtgaataaagagcgcatgatgcgtctggccgagtacagccgcgccagcctgcaagcgctgcgcacggaaaccggcatcgcctacgagcagcgcaccggcggcacgctgcaggtgtttcgcagtcaggtgcagctcgatgcggtgcagcgcgacgtgaccgtgctcgaagaatgcggcgtgccctacgaactgctcgaccgcgaccaactcgcccaggtcgagcccggtctggcgcacgcccgcgaccggcttgtcggcggcctgcgcctgccgcacgacgaaaccggggattgccagatattcaccatccgtctgggcgagatggcgcgcgaactgggcgtgaaattcgagttcggccagaccctccgcggactgtcgagcgacggccagcgcatcaccggcgtgcaggtgggagacgccgtactcaccgcggatcgctatgtgctggcgctgggtagttacacccgcgactttctggcgccgctgggcctcgatctgccggtctatccggtcaagggctactcgctcaccgtgccgctgaccgacgagtcgctcgcgccgcggtccaccgtgctggacgaaacctacaaaatcgccctcacccgcttcgatcaacgcatccgcgtgggcggcatggcggagctgggcggattcgatctgcggctcaacccgcgtcggcgcgaaacactggaaatggtcacccgcgatctgttccccggtggcgacctcgccgctgccaccttctggaccggcctgcgtccgatgacgcccgacagcacgcccatcgtcggcgccacgcgctatcccaacctctacctcaacaccggccacggcaccctggggtggaccatggcctgcggttcaggccgggtcgtgagtgatctggtgctcaaccgcaagccggagatcagcatcgccggtctgggtatcgagcgctacgaccgcccggccacgccgcccaaagtgctgcattccagccacgcctga

SEQ ID NO: 634 - protein, 430 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
MKVIVLGAGVIGTTTAYYLAKAGAEVTVIDRQNACAMETSFANAGQVSPGYSTPWAAPGIPLKAVKWMFQRHAPLAIRPDGTLWQLRWMAQMLRNCSAERYAVNKERMMRLAEYSRASLQALRTETGIAYEQRTGGTLQVFRSQVQLDAVQRDVTVLEECGVPYELLDRDQLAQVEPGLAHARDRLVGGLRLPHDETGDCQIFTIRLGEMARELGVKFEFGQTLRGLSSDGQRITGVQVGDAVLTADRYVLALGSYTRDFLAPLGLDLPVYPVKGYSLTVPLTDESLAPRSTVLDETYKIALTRFDQRIRVGGMAELGGFDLRLNPRRRETLEMVTRDLFPGGDLAAATFWTGLRPMTPDSTPIVGATRYPNLYLNTGHGTLGWTMACGSGRVVSDLVLNRKPEISIAGLGIERYDRPATPPKVLHSSHA

SEQ ID NO: 635 - DNA, 1296 bp, Unknown
  Obtained from environmental sample
atgaaagtcattgttctcggtgcgggggtgattggaaccaccacggcctactatctcgccaagtccggcgcggaggtcaccgtcattgaccggcaggacgcctgcgccatggaaaccagcttcgccaacgcgggtcaggtgtcccccggctactccaccccctgggccgcgccgggcattccgctcaaggcggtgaaatggatgttccagcgccatgcgccgctggccatccgacccgacggcagcctgtggcaactgcgctggatggcgcagatgctgcgcaactgcaccgcagagcgctacacggtcaacaaggaacgcatgatgcggctggccgaatacagccgcgccagcctgcaggcactgcgtgccgaaaccggcatcgcctacgagcagcgcaccggcggcacgctgcaggtgtttcgcagccagtcgcagctcgacgcggtgcagcgcgacgtggccgtgctggaggaatgcggcgtgccctaccagttgctcgaccgcgaccagcttgccactgtcgagcccggcctggcccacgcccgcgaccgtctggtgggcggcctgcgtctgcccaacgatgaaaccggcgactgccagttgttcaccacccgcctgggcgagatggcccgcgccctgggtgtggagttccgcttcggccagaccatcagcggcctgtctggcgacggccagcgcatcaccggtgtgcgggtgggcgatcaaaccctcactgccgatcgctatgtgctggcgctgggcagctacacccgcgactttctcgcgccgctcgggctggatttgccggtctatccggtcaagggctactcactcaccgtgccgctggtgaatgaggcgctcgcgccgcgctccaccgtgctcgatgagacttacaaaatcgccgtcacccgttttgacaagcgcattcgcgtgggcggcatggccgagctgggcggattcgatctgcgcctcaacccgcgtcggcgcgaaacgctggaactggtcacccgcgacctgttccccggcggcgatctggccgcagccgacttctggaccggcctgcgccccatgacccccgacagcacgccgatcgtcggcgccacacgctaccccaatctgttcctcaacaccggccacggcaccctgggctggaccatggcctgcggctcgggccgcgtggtgagcgatctggtcttgaaccgcaagcccgacatcagcaccgaaggactcgggctggagcggtatgcaccgcacgcgcccgcaccacgtctgcagcatcactccaaacccgcatga

SEQ ID NO: 636 - protein, 431 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
MKVIVLGAGVIGTTTAYYLAKSGAEVTVIDRQDACAMETSFANAGQVSPGYSTPWAAPGIPLKAVKWMFQRHAPLAIRPDGSLWQLRWMAQMLRNCTAERYTVNKERMMRLAEYSRASLQALRAETGIAYEQRTGGTLQVFRSQSQLDAVQRDVAVLEECGVPYQLLDRDQLATVEPGLAHARDRLVGGLRLPNDETGDCQLFTTRLGEMARALGVEFRFGQTISGLSGDGQRITGVRVGDQTLTADRYVLALGSYTRDFLAPLGLDLPVYPVKGYSLTVPLVNEALAPRSTVLDETYKIAVTRFDKRIRVGGMAELGGFDLRLNPRRRETLELVTRDLFPGGDLAAADFWTGLRPMTPDSTPIVGATRYPNLFLNTGHGTLGWTMACGSGRVVSDLVLNRKPDISTEGLGLERYAPHAPAPRLQHHSKPA

SEQ ID NO: 637 - DNA, 1128 bp, Unknown
  Obtained from environmental sample
atgacccaggcagacttcatcatcatcggcggcgggatcgccggggcatccaccggctactggctgtcgcgccatggccgggtactggtgctggagcgcgaatcccatccggcctaccactccaccggacgctccgcggccctctacaccgccgcctacggcaccgcccaggtacgtgccctgaccctggccagccgagactttttcgacgccccgcccgaaggcttctgcgaacacccgctgctgaccccgcgcggcgaaatgaccgtggacttcaccggcgaccccaccgagctgaacaaccagtacctcagcgccaaggccacggtgccggaagtacagctgctcagcgccgacgaagcctgcgcgcgcctgccgatcctgcgccgcgagaaagtccacggcgcgctgtacgacccgagcgccagcgacatcgataccgacgccctgcaccagggctacctgcgcggtatccgccgcaaccagggcgaaatccgcaccgactgcgaagtgctggggctgagccgcgacgcacagggcctctggcaggtgcgaaccgccggccagaccttcagcgcgccgatcctgatcaacgccgccggcgcctgggccgaccagctcggcgtaatggccggcgcccggcctttgggcctgcagccgaaacgccgcgcggcctttatcttcgccggacccgaaggcgtcgacagccatcgctggccgatgctggtgagcctcgacgaatccttctacatgaagcccgacgccggcatgttcctcggctcgccggccaacgccgacccggtggaaccccacgacgtgcagccggaagaactggacatcgccatgggcatctaccagatcgaagaagccaccaccctgacgattcgccgcccgacccggacctgggccgggttgcgcagtttcgtcagcgacggcgacctgctggccggcttcgacacccaggtgccggggctgttctgggtcgccgcgcaaggcggctacggcatccagacctcgcctgccatgggccaggccagcgccgccctggtgcgcggcgaagccctgccggaacagctggcgcgctttggcctggatagcgccatgctctcccccgcccgtctcggctga

SEQ ID NO: 638 - protein, 375 aa, Unknown
  Obtained from environmental sample
  DOMAIN (5)...(349): FAD dependent oxidoreductase
MTQADFIIIGGGIAGASTGYWLSRHGRVLVLERESHPAYHSTGRSAALYTAAYGTAQVRALTLASRDFFDAPPEGFCEHPLLTPRGEMTVDFTGDPTELNNQYLSAKATVPEVQLLSADEACARLPILRREKVHGALYDPSASDIDTDALHQGYLRGIRRNQGEIRTDCEVLGLSRDAQGLWQVRTAGQTFSAPILINAAGAWADQLGVMAGARPLGLQPKRRAAFIFAGPEGVDSHRWPMLVSLDESFYMKPDAGMFLGSPANADPVEPHDVQPEELDIAMGIYQIEEATTLTIRRPTRTWAGLRSFVSDGDLLAGFDTQVPGLFWVAAQGGYGIQTSPAMGQASAALVRGEALPEQLARFGLDSAMLSPARLG

SEQ ID NO: 639 - DNA, 1002 bp, Unknown
  Obtained from environmental sample
gtgtcccaagctcctgttcggattggtgttgtcggcctcggttactggggcccgaatctcgcgcgaaacttcgcaaacctgccggaggcgcagctgcgctggtgctgcgacgcctccgaccaagcgcgggcgcgagtcgccgcgctgttccccggcgccaagctgtcggattcccttgatgagctgctcgacgaccctgaactcgacgcggtggtgctggcaacgccggtaccgacgcacgccgatctggcggtgcgcgtcctggaggccggcaagcactgcttcgtcgagaagccgctggcgcaatcggtcgccgacgcgcagcgggccgtcgatgccgccgcacgcactggtaagacgctgttcgtcggccatctgctcgaataccacccgggtgttcgcaagctcaaggagctcgccgatagcggtgagctgggcgagatctactacatctacgggaaccggctgaacctcggcaagctgcgggccgacgagaacgcgctgtggtcgcttggcgcgcatgacatctcggtgctgctggcgctggcgggcgaggagccgatcgagctggtcgcccacggtgagtcctacgtgcgtcccggcgttgaggatgtcgtcttctgcttcctgcggttcccgtcggggctctcagcgcacctacatctgagctggctggacccgcataaggaacgccgcttcacggtcgtcggcgcgaagcggatggcgaccttcgacgacatggcgctcgagggcaaggtcacgatctacgacaagggcttcgatgaggcgaccagcgggtacggcgagtacatcacccgttccggcgacatcttctcgccgcggctgccgagcgtcgagccgctgcgcgtcgaatgccagcacttcgtgcagagcatcctgaccggtgaacggccccgctccgacggcgagagcgggctgcgggtcgtgcgggtcctggagggtctgcagaactcgctgaagcggtccgcccgtgagcgctag

SEQ ID NO: 640 - protein, 333 aa, Unknown
  Obtained from environmental sample
  DOMAIN (6)...(125): Oxidoreductase family, NAD-binding Rossmann fold
  DOMAIN (7)...(113): Semialdehyde dehydrogenase, NAD binding domain
  DOMAIN (12)...(124): Homoserine dehydrogenase, NAD binding domain
  DOMAIN (137)...(235): Oxidoreductase family, C-terminal alpha/beta domain
MSQAPVRIGVVGLGYWGPNLARNFANLPEAQLRWCCDASDQARARVAALFPGAKLSDSLDELLDDPELDAVVLATPVPTHADLAVRVLEAGKHCFVEKPLAQSVADAQRAVDAAARTGKTLFVGHLLEYHPGVRKLKELADSGELGEIYYIYGNRLNLGKLRADENALWSLGAHDISVLLALAGEEPIELVAHGESYVRPGVEDVVFCFLRFPSGLSAHLHLSWLDPHKERRFTVVGAKRMATFDDMALEGKVTIYDKGFDEATSGYGEYITRSGDIFSPRLPSVEPLRVECQHFVQSILTGERPRSDGESGLRVVRVLEGLQNSLKRSARER

SEQ ID NO: 641 - DNA, 1128 bp, Unknown; identical to SEQ ID NO: 637
  Obtained from environmental sample

SEQ ID NO: 642 - protein, 375 aa, Unknown; identical to SEQ ID NO: 638
  Obtained from environmental sample
  DOMAIN (5)...(349): FAD dependent oxidoreductase

SEQ ID NO: 643 - DNA, 1266 bp, Unknown
  Obtained from environmental sample
atgacccgggcccggcatgtggtcgtgatcggcgccggcgtggtcggcagctgtactgcgcaggctttggccgagcgtgggctggccgtgaccctggtcgaccggcatgccgaagcggcggccgagaccagccacgccaacggtggttgcctgactcccggccatgccgagccctggaactcgcccggcattgccgcgcgcctgctgcgccggtctggccagcacgagccgttccgcatctttgcccacgctctgccgggcttgcttggctggggctggcaatttctgtggcagtccaaggcctcgcgctactaccgcaatgcccgcgccaacacccgcctggcggtcttttcgggtcaatgcctggccgagctgcgccagcgccatgtcttcgactaccacgcctggaccgagggttcgctggagctgtatttcgattcggccgaactcgaacatgccgccgaactgcggcggcagatcggcgatcccggggtgaagatcgaagcgattgatgtcgcgcgcgtgatcgaactggaaccggccctggctccggttgccgggcgcatggttggcggcctgttgatgcccaggcatgagtcgggcgatgtctgcgagttctcggccgagatggcccgcctggcggccgaacagggtgccagcttgcgcttcggttcggccgtgcggcgtatcgtcagcgaccggggccgggtgcttggagtcgaactggccgacgaactgatcgaggccgatgcggtggtactcgcggctggcgtggccagcccggccctggcccggccgctggggctgaagttggcgatccagccggtcaagggctattcgctgacgctggagctggaacagcccgaactggccccgacgatgccgctgctggacctggaacaacgcatcgtcgcctcgcgctacggcaatcgcctgcgcctggccggactggctgatttcgacggttatagccgccaggttcgtccggagcgcttgcagctcctggtcgattcggcctgtaccctgctgccccgtttgagcgatgaaatccgctccgaccgagccgaagcctggaccggcctgcgcccgatgacgcccaagggcccgccgatgctgggtccgacccccgtgcccggacttttcctgaacaccggccacggctcgatgggctggacccaggccgccggctcggccaggatcctggccgacctgctgaccgggcgggagccgcagatcaatctgtccggattggggtatcggggttaa

SEQ ID NO: 644 - protein, 421 aa, Unknown
  Obtained from environmental sample
  SIGNAL (1)...(24)
  DOMAIN (6)...(404): FAD dependent oxidoreductase
  SITE (419)...(422): N-glycosylation site. Prosite id = PS00001
MTRARHVVVIGAGVVGSCTAQALAERGLAVTLVDRHAEAAAETSHANGGCLTPGHAEPWNSPGIAARLLRRSGQHEPFRIFAHALPGLLGWGWQFLWQSKASRYYRNARANTRLAVFSGQCLAELRQRHVFDYHAWTEGSLELYFDSAELEHAAELRRQIGDPGVKIEAIDVARVIELEPALAPVAGRMVGGLLMPRHESGDVCEFSAEMARLAAEQGASLRFGSAVRRIVSDRGRVLGVELADELIEADAVVLAAGVASPALARPLGLKLAIQPVKGYSLTLELEQPELAPTMPLLDLEQRIVASRYGNRLRLAGLADFDGYSRQVRPERLQLLVDSACTLLPRLSDEIRSDRAEAWTGLRPMTPKGPPMLGPTPVPGLFLNTGHGSMGWTQAAGSARILADLLTGREPQINLSGLGYRG

SEQ ID NO: 645 - DNA, 1245 bp, Unknown
  Obtained from environmental sample
atgtctcgtgaaaccgtcgttctgggagccggcatggtcggcgtctccatcgcctggcatctggctcgtcgcggtcgctcggttcttctggtggatcgccgaccgcccggccaggagacgtcctatggcaatggcgggctgattcaacgcgaggcggtacgcccctatacctttccgcgcgaacttggcaagttgctgagttcactaccgaaccggcgggtcgacattcgctaccaatggcgcggtgtgctgcagttcgccgggcctctgctcggctattggcgatattcggctgccacgccctatgcgcgcatcgtgcccgagtacgcctctttgattgccctgagcacagaggagcatgcaccgatgatcgcggccgccggtgcgggggagttgatcggcaagaagggctggctcgaagtccatcgcagccaggcggaattcgatcgccgtgcacgagaggctgaggatgccgccaatcgcttcggtgtgacgcatgagcgcctcgatggcgcggggctcgctcacaaggagcccgagttgagccccggcctggcaggggcaattcactggaccaattcctggagcgtggccgaccctggcggtctggttaccgcctatgcgcgcagcttcgaacagcagggcggtgaatttcttcaggccgcggtgcaggacgtgagtcaggtggggggcggctggcgtatcggcaccgaccagggagatatcgaagcccgcgatgtcgtactggcgtttggcccctgggccggcccctggctcaaggcgttgggctaccgcttgccgaccttcgtcaaacgcggttatcacatgcactatggcgctgccgagggaaggcgtatttctcattggctggccgatgccgatatcggctatatcctggcgccgatgcgggccgggattcggctcaccaccggagctgagcttgcctgtctcgatgcgccacccgcccacggtcagctggctgccgccgagcgctgcgcccgcgaactctatccttgcctgggcgagcgcctcgaggcggaaccgtggaggggggcgcgtccgtgcctgcctgacatgaagcccgtgattgggcctgcgccacgtcatcgcgggttatggttcgccttcggtcatggccaccagggcttcaccatggggccggccactgggcgtgtgctggcggaactcatggaaggggagcccaccgccgtagacctcacaccgtttcgcgccgaccgtttctag

SEQ ID NO: 646 - protein, 414 aa, Unknown
  Obtained from environmental sample
  DOMAIN (4)...(396): FAD dependent oxidoreductase
MSRETVVLGAGMVGVSIAWHLARRGRSVLLVDRRPPGQETSYGNGGLIQREAVRPYTFPRELGKLLSSLPNRRVDIRYQWRGVLQFAGPLLGYWRYSAATPYARIVPEYASLIALSTEEHAPMIAAAGAGELIGKKGWLEVHRSQAEFDRRAREAEDAANRFGVTHERLDGAGLAHKEPELSPGLAGAIHWTNSWSVADPGGLVTAYARSFEQQGGEFLQAAVQDVSQVGGGWRIGTDQGDIEARDVVLAFGPWAGPWLKALGYRLPTFVKRGYHMHYGAAEGRRISHWLADADIGYILAPMRAGIRLTTGAELACLDAPPAHGQLAAAERCARELYPCLGERLEAEPWRGARPCLPDMKPVIGPAPRHRGLWFAFGHGHQGFTMGPATGRVLAELMEGEPTAVDLTPFRADRF

SEQ ID NO: 647 - DNA, 1296 bp, Unknown
  Obtained from environmental sample
atgaaaatcgccgttctgggcgccggggtcgtgggaacgaccaccgcctactaccttgcacgtgccggccatgaagtcgacgtctacgaacgtcaggacggcgctgccctcgaaaccagttttgccaacgccggccagatttccttcggatattcatcgccgtgggcggcgcctggagtcccgctcaaggccgtgaagtggatgttcgccaagcacccgccgttgacgatccgtcccgatggctctttgacgcagttacgctggatgttcgacatgtggcgcaactgcaccgccgcccgttacgccgtgaacaaggagcggctgctgcgcatctccgattacagccggcattgcctggcgcagttgcgagaggaaaccggcatcgaatacgaaggcaggcagcggggcacgctgcaactgtttcgcacggagcagcagctcgaggccgccgcccgggacatgcgggcgctcgctgaggcaggcgtaccgttcgagttgctgacttctgaacaactggccgacgccgagccggggctggcagcgagtgcgcacaagtttaccggcggcctgcgcacacccggcgacgaaacgggcgactgccacctcttcaccacccggctggccgagcaggcccggaaattgggcgtccgcttccactacggcatgccactcgacacgctgctcacggaaggcaataccgccgtcggcgttcaaagcggtggccatcgcattgaggccgatgcgtacgtactggccctcggttcgtggtccagccgcttcctgcgcggcgtgctgcgcctcccggtctatccgctcaaggggtattccatcaccgtgccaatcgccgatgaatcgcgggcgcccgtctctaccctgctcgacgaaagctacaaagtggccgtgacgcgattcgatgatcgtatccgggtcggcggcatggccgagatcgtcggctacgacatgcgtctcaacccccgccgccaggcgactcttgaaatggtggtggatgacctgttcccgggtgcaagacggccaggaaacgtcacattctggactggtttacggcccaagacacctgacagcacgcccatcatcggctcgacacccgtgaagcggctgtatctgaacacaggccatggcacactgggctggaccatgtgttgcggcagcggccgcctgctggcggacatcatttcagggcgtgcgccagagattcgcgccaacgatctttctgtgcatcgctactacggcagcctgccgggcaacccgccatcgggccggcctgccactgcttga

SEQ ID NO: 648 - protein, 431 aa, Unknown
  Obtained from environmental sample
  DOMAIN (2)...(397): FAD dependent oxidoreductase
  SITE (96)...(99): N-glycosylation site. Prosite id = PS00001
  SITE (352)...(355): N-glycosylation site. Prosite id = PS00001
MKIAVLGAGVVGTTTAYYLARAGHEVDVYERQDGAALETSFANAGQISFGYSSPWAAPGVPLKAVKWMFAKHPPLTIRPDGSLTQLRWMFDMWRNCTAARYAVNKERLLRISDYSRHCLAQLREETGIEYEGRQRGTLQLFRTEQQLEAAARDMRALAEAGVPFELLTSEQLADAEPGLAASAHKFTGGLRTPGDETGDCHLFTTRLAEQARKLGVRFHYGMPLDTLLTEGNTAVGVQSGGHRIEADAYVLALGSWSSRFLRGVLRLPVYPLKGYSITVPIADESRAPVSTLLDESYKVAVTRFDDRIRVGGMAEIVGYDMRLNPRRQATLEMVVDDLFPGARRPGNVTFWTGLRPKTPDSTPIIGSTPVKRLYLNTGHGTLGWTMCCGSGRLLADIISGRAPEIRANDLSVHRYYGSLPGNPPSGRPATA

SEQ ID NO: 649 - DNA, 1245 bp, Unknown
  Obtained from environmental sample
atgtcgcgcaatatagtcgttctgggtgctggtatggtcggcgtgtccgttgcctggcacctgatccgcagagggcacagggtcacgctggtggaccgtcgcgaaccgggacgggaaacctccttcggcaatgccggggtcatccagcgcgaggctgttcgcccttacgggtttccccgggacataggcaccctgctgcgggttctgcccaatcgccaggtggatatccgctaccggccgacgggcatgctgaatgccgcggttccgctgttccagtactggctcaattccggtggccagcgctaccagcgtatcgtgcgggaatgggcatcgctgatccagcgctgccagcacgcccatggccccatgatcgaggccgccggtgcctgggatctggtacgcaagggcggctggctggagctgtaccggactcgaaaggcgctggaagagcgcgttgccgaggccaatgaggaccgaggccgtttcggtatcgagttcgacgtactcgacgcaccacggttgcgtgcccgcgagccatggctggcgaaggacctgatcggtgccatccactggacccagccctggatggtcagcgatccaggtgcgctggtgcaggcctatgcccggaacttcgtcgagcagggggggaagttgatgcaggccagcgtcgaggatgtcctggaggagggcggccgctggcgaatcctgacctcggaaggcgagctgcaggcagatcaggtggtcgtggccatggggccgtggtccagtcggctgctggcccgtgtcggcatccgcgtgcccctgttcgtcaagcgcggttaccacatgcactacagcacgggtgaaggcgccgaactgaatcactggctgatggatgcggaacggggtttcatgatggagcccatgcgtgccggcatccgcctgaccaccggcgccgagctggcggacctggatgcgccgccgaaatacgggcagctggccgcggcggagaaggcggcgcgggcactcttcccggcactgggtgagcgactggaccccagcccatggaaaggcgcgcgtccctgcctgccggacatgaagcccgtgatcgggccggcgccccagaagggcctgtggctggcattcggacatggtcaccagggctttaccctgggaccggctaccggcgagctgctggcgcagatgatggatggggagacgccggccatcgacatggcgccgttcgcggtgcaacgtttcctctga

SEQ ID NO: 650 - protein, 414 aa, Unknown
  Obtained from environmental sample
  DOMAIN (4)...(395): FAD dependent oxidoreductase
MSRNIVVLGAGMVGVSVAWHLIRRGHRVTLVDRREPGRETSFGNAGVIQREAVRPYGFPRDIGTLLRVLPNRQVDIRYRPTGMLNAAVPLFQYWLNSGGQRYQRIVREWASLIQRCQHAHGPMIEAAGAWDLVRKGGWLELYRTRKALEERVAEANEDRGRFGIEFDVLDAPRLRAREPWLAKDLIGAIHWTQPWMVSDPGALVQAYARNFVEQGGKLMQASVEDVLEEGGRWRILTSEGELQADQVVVAMGPWSSRLLARVGIRVPLFVKRGYHMHYSTGEGAELNHWLMDAERGFMMEPMRAGIRLTTGAELADLDAPPKYGQLAAAEKAARALFPALGERLDPSPWKGARPCLPDMKPVIGPAPQKGLWLAFGHGHQGFTLGPATGELLAQMMDGETPAIDMAPFAVQRFL

SEQ ID NO: 651 - DNA, 1236 bp, Unknown
  Obtained from environmental sample
atggcacgggaagtcatcgttttgggcgccggcatcgtcggcgtgagcaccgcggcccacctcgcgctgcgcggtttcgccgtcacgctcctggaccgcaagagcccggggcgcgaaacctcgtacggcaatgcgggcgtgatccagcgcgaagccgtcgagcccttcgggtttccccaggacatgcgcacgctgtaccgcgcggcgctcaagatcggcgccaaggtcaactaccacctgggcgcgctgcccgggatggcgggcgagctggtgcgttattggtcgaactcgcgccccgcagcgcacgcgctcgtctcgcagcatcacgcgcgcatgatcggccactgcctgtccgagcacgagttcctgatgtccctggccggcgcgcaggacctggtccggcgcgccggttttcgcttcctctatcgcgagcaggccacgatggacagtgccatctcgcgcgcgcaaaggctggagcgggagtacggcgtcactttctcggtagaagacggccgcgagatcaggcggctcgagcctcacctgaagcgcgaagtggccggcgcggtgcactggctggacccgtggtcggtgaacgatccgggcgaactcgtttcgcgatatgccgcgctcgtcgtgaagcacggcggccgcatcgtcaccggcgatgcgcaatcgctgcagcccacggcgacaggctggtgcgtggattcggacaacggccacatcgaggccgaactggcggttgtcgcgctcggcccctggtcggccgaactcgcaaagacactcggctaccgtttcccgctcatcccgatccgcggctatcaccagcactacgacggcgcgggacccgacctgccgatggtcgatgtggacggcggctatatggtgtcgccgatgcggcaaggcgcgcgcatcacgaccggcggcgagttcggccggctcgaatcggcctccacgcccgtgcaactggcgcgcgcggaaaagctggcgcgcgaactgttcgacctcggcgatgcaccggattcaccgccgtggcgcggcgcgcggccctgcatggtggacctgctgccggtgatggggccggccagcaaacatccaggcctgtggttcaacttcggccacgcgcaccagggcttcacgctggggccggtgagcggccgtttgctggcggagatgatcgcgggcgaatcgacgttcatcgacgcgcgcccttacacgcccgcacgcttcggatag

SEQ ID NO: 652 - protein, 411 aa, Unknown
  Obtained from environmental sample
  DOMAIN (4)...(392): FAD dependent oxidoreductase
MAREVIVLGAGIVGVSTAAHLALRGFAVTLLDRKSPGRETSYGNAGVIQREAVEPFGFPQDMRTLYRAALKIGAKVNYHLGALPGMAGELVRYWSNSRPAAHALVSQHHARMIGHCLSEHEFLMSLAGAQDLVRRAGFRFLYREQATMDSAISRAQRLEREYGVTFSVEDGREIRRLEPHLKREVAGAVHWLDPWSVNDPGELVSRYAALVVKHGGRIVTGDAQSLQPTATGWCVDSDNGHIEAELAVVALGPWSAELAKTLGYRFPLIPIRGYHQHYDGAGPDLPMVDVDGGYMVSPMRQGARITTGGEFGRLESASTPVQLARAEKLARELFDLGDAPDSPPWRGARPCMVDLLPVMGPASKHPGLWFNFGHAHQGFTLGPVSGRLLAEMIAGESTFIDARPYTPARFG

SEQ ID NO: 653 - DNA, 1344 bp, Unknown
  Obtained from environmental sample
atgacagacagcttcgacctgatcgtgctcggcgccggctccggcggcctggccacggccttccgcgccgcgcgccacggcgcgcgggtggccctgctggaatccggcgtgctgggcggcacctgcgtcaacgtcggctgcgtgccgaagaaggcgatgtggtacgccgcgcagatggccgagatgcagcagctggccgtcgactacggtttcgccagccggcccgggccgctggactggccgaccttcgtggcgcaccgccaggcctacatcgaccgcatccacgccggctaccgcaagcgcctggccgaatcgggcgtcgaactgatcgcggcccgcggcgcgctggacgggccgcatgcggtgaaggcgggcggacgcagcctgcaggcgccgcacatcgtcgtcgccaccggcgcgcggccgcgccgcctggacacgccgggcttcgaactgggcatcgtctccgacggcttcttcgacctgcgggcaagtccgcggcgcgtcgccatcgtcggcggcggctacatctcggtggaactgggcggcgtgctgcgcgcgctcggcgccgaggtggagatcttcgcgcgcggccacctgatgcgcggcttcgacgcgcacctgagcttggcgctgggcgaggcgatgcgcgagctgggcatccgcatccactaccagtgcgacatcgaagcggcgcggcgcgaaaaggacggcgtcgtgctcgactgcagcgcgggcgaccgcatgggtccgtacgacgtgctgctgtgggcggtcggacgcgtgccgaacagcgacggcatcggtctcgaggcgcagggcgtggaactcgacgcccgcggccacgtgctggtcgatgcgcggcagaacaccgccgccgcgggcatctacgcgatcggcgacgtcaccgaccggctggcgctgacgccggtcgcgatcgccgccgggcggcggctggccgatcgcgtgttcggcggcgacgacgatgcgttcctcgactacgagaacatccccagcgtggtgttctcgcacccgccgctggccggcgtcggcctgaccgagcaggccgcgcgcgagctgcacggcgatgccgtgcgggtcttcacctcgcgcttcacgccgatgcagctggcgctgtcggcgcacccgcaaccgatgctgatgaagctggtctgcgccggcgacgagcagcgcgtggtcggcgtgcacatgctcggccccggcgccgacgagatactgcagggcttcgcggtcgcggtgaagatgggcgcgcgcaaggccgatctcgacgccacggtggcgatccatccgacgtcggcggaggagttggtgttgatgggttga

SEQ ID NO: 654 - protein, 447 aa, Unknown
  Obtained from environmental sample
  DOMAIN (6)...(306): Pyridine nucleotide-disulphide oxidoreductase
  DOMAIN (6)...(322): FAD dependent oxidoreductase
  DOMAIN (168)...(260): Pyridine nucleotide-disulphide oxidoreductase
  DOMAIN (337)...(447): Pyridine nucleotide-disulphide oxidoreductase, dimerisation domain
  SITE (39)...(49): Pyridine nucleotide-disulphide oxidoreductases class-I active site. Prosite id = PS00076
  SITE (245)...(257): EF-hand calcium-binding domain. Prosite id = PS00018
MTDSFDLIVLGAGSGGLATAFRAARHGARVALLESGVLGGTCVNVGCVPKKAMWYAAQMAEMQQLAVDYGFASRPGPLDWPTFVAHRQAYIDRIHAGYRKRLAESGVELIAARGALDGPHAVKAGGRSLQAPHIVVATGARPRRLDTPGFELGIVSDGFFDLRASPRRVAIVGGGYISVELGGVLRALGAEVEIFARGHLMRGFDAHLSLALGEAMRELGIRIHYQCDIEAARREKDGVVLDCSAGDRMGPYDVLLWAVGRVPNSDGIGLEAQGVELDARGHVLVDARQNTAAAGIYAIGDVTDRLALTPVAIAAGRRLADRVFGGDDDAFLDYENIPSVVFSHPPLAGVGLTEQAARELHGDAVRVFTSRFTPMQLALSAHPQPMLMKLVCAGDEQRVVGVHMLGPGADEILQGFAVAVKMGARKADLDATVAIHPTSAEELVLMG

SEQ ID NO: 655 - DNA, 1284 bp, Unknown
  Obtained from environmental sample
atgagcgcattggcgccatgccgtcaggggagtgagttcatggctcgaacggacgcgatcgtgctcggggccggcattgtcggcacatcgaccgcgctgcatctcgccaagcgcgggctgtcggtcgcgctcatcgacaggggaggcccgggggaggggacgagctacggcaacaccggcgtcatcgtgggggcgagcaacctgccgacgccgttcccgcgcaagctggccgcactggtccgcatcgccctgaagaaggcgccggaggcgaactatcactggtcgcatctgccgaaggtcgggccctggctgctggcctactggcgcgaatcgacccccgcacggatcgaccgcgcggcgcggctgctgcagccgatcatggcgcgggccttgcccgagcacgaggcgctgatcgcggaatcgggtgcgcagcgcttcctgcgcaagaccggttggctcatcctctaccgcaacgaggcggcgttcgacggcgcaaaggcgcaactcgactttgcggccgagatgggatcgaggccgcaggtgctcgacaccgaggcgacgcgcgcgctcgaaccgagcctcgccccggtttttcgccgcgccgtctattgggacgatgtcgcgagcctctcgaacccgctcggcgtgacgcgcgccttcgccgagcgcttcaaggcactcggcggaatcgtcctgcagggcgatgcgcgcacgctgcaccgcgcggaggggcgctggcgtctcgacaccgacgagggccatgtggattcgccaaatgtggtggtcacgctcggtccctgggcgccggacctgctcgagccgctcggcatcaagctgccgctcggcatcaagcgcggctatcaccgtcatttccggccggccgggaacgcgtcgctgtcccggccgatcatcgataccgagaacggctatgcgatcacgcccatggagcagggcatccggctcaccaccggcgcggagtttgcgaaccgcgacgccccggcgacgccggtgcagttcgagcggctgatgccggccgccaagcagctgtttccgctgggcgagccggtcgagcccgagccctggctaggcaggcgcccctgctttcccgactccatgcccgtcatcggcccggcacccggtcaacccgggctctggctcggcttcggccacggccattggggcctgacactcgggccggcgaccgggcgtctggtcgcggaactggtcaccggccagaccccgttctgcgatccggcgccttaccgggcagagcggttcatgtga

SEQ ID NO: 656 - protein, 427 aa, Unknown
  Obtained from environmental sample
  DOMAIN (18)...(408): FAD dependent oxidoreductase
  SITE (300)...(303): N-glycosylation site. Prosite id = PS00001
MSALAPCRQGSEFMARTDAIVLGAGIVGTSTALHLAKRGLSVALIDRGGPGEGTSYGNTGVIVGASNLPTPFPRKLAALVRIALKKAPEANYHWSHLPKVGPWLLAYWRESTPARIDRAARLLQPIMARALPEHEALIAESGAQRFLRKTGWLILYRNEAAFDGAKAQLDFAAEMGSRPQVLDTEATRALEPSLAPVFRRAVYWDDVASLSNPLGVTRAFAERFKALGGIVLQGDARTLHRAEGRWRLDTDEGHVDSPNVVVTLGPWAPDLLEPLGIKLPLGIKRGYHRHFRPAGNASLSRPIIDTENGYAITPMEQGIRLTTGAEFANRDAPATPVQFERLMPAAKQLFPLGEPVEPEPWLGRRPCFPDSMPVIGPAPGQPGLWLGFGHGHWGLTLGPATGRLVAELVTGQTPFCDPAPYRAERFM

SEQ ID NO: 657 - DNA, 1008 bp, Unknown
  Obtained from environmental sample
atgcaaaatcatacccaagaaactaaacccgtaattactgtgctgggttgtggggtaagcggccttaccacggccattctgctgttggagagtggctatccggtgcagatctgggccagggatttgccgccgcgcaccacctccaatattgctgcagcggtctggtatccctacaaagtggcgccggaaggcaaggtagccgaatggggcgaacgcagttatgccattttctgcgaactggccgaggtggaggggactggcatcaaaattttgccggggatcgagcttttccgccaccccaccctcgacccaatctggtcgcgctttgtacgcaattatcgccgcgtacagccccacgaattacctgccggctaccaggatggctattttttcgactcgccggtgattgatacgggaatttacatcgcttatctggtgcagcgggtgcatgaactgggcggccagatcagccagcgcgaaataggttcgctggcggaagcttttcaggatagcaagctggtgattaattgcaccgggttaggctcgcggacgctactgggcgacaaagaaatctatccgattcgcggccagattatgcgggtaactcgtgacgggctaaaggatttcttcgttacctccgataacgagggcgtcgccaattatgtggtgccgcgctccaacgattgcatcctgggcggtaccgccgatgtaggggaatggtcgctggagccaaacgaggccaccgccgccaaaatttgggaggattgccgccagttagtgccggaagtagccaatacgcaaatccttgaacacctggtcggcctgcgaccggctcgcaaggaagtccgcctggaagccgaagtattgcctgatgccagcgttgtcatccataactacggacatggaggcgcgggcgtaaccatttcctggggttgcgctgagcaagttctgagtttagtccgggtttttagcccccaaggacttggcctcgaacagagtaaagtttaa

SEQ ID NO: 658 - protein, 335 aa, Unknown
  Obtained from environmental sample
  DOMAIN (11)...(319): FAD dependent oxidoreductase
  SITE (3)...(6): N-glycosylation site. Prosite id = PS00001
  SITE (178)...(181): N-glycosylation site. Prosite id = PS00001
  SITE (299)...(317): D-amino acid oxidases signature. Prosite id = PS00677
MQNHTQETKPVITVLGCGVSGLTTAILLLESGYPVQIWARDLPPRTTSNIAAAVWYPYKVAPEGKVAEWGERSYAIFCELAEVEGTGIKILPGIELFRHPTLDPIWSRFVRNYRRVQPHELPAGYQDGYFFDSPVIDTGIYIAYLVQRVHELGGQISQREIGSLAEAFQDSKLVINCTGLGSRTLLGDKEIYPIRGQIMRVTRDGLKDFFVTSDNEGVANYVVPRSNDCILGGTADVGEWSLEPNEATAAKIWEDCRQLVPEVANTQILEHLVGLRPARKEVRLEAEVLPDASVVIHNYGHGGAGVTISWGCAEQVLSLVRVFSPQGLGLEQSKV

SEQ ID NO: 659 - DNA, 1245 bp, Unknown
  Obtained from environmental sample
atgcgcgtaatagtgctgggggccggcgtgatcggcgtgacttcggcgtggtatttggcccaagccgggcacgaagtgacggtggtggatcgccaaccggatgccggccttgaaactagctttgccaacggtagccaaatttccgtgtgccatgcggagccctgggccaatccggcagtgttttccaaattgttgcgttggttggggagagaggacgcaccgctgttgtggcgttttcggtgggacccagcccaatgggcctggggactgcgcttcctggctcaatgcggccccactcgaacccggcagaacattgaagcgctggttgccctcggcttgcacagccgggccagcttgcagtcactccgtacggagttgaatctgcaatacgaccagttggaaaagggcatactgcatttctataccgatgcccgtgaatttgagcatgcacgtccccaggcagaactcatgacccaactgggctgcccccgtcgggtagtttccacggctgaatgtctggccctagagcccgccctgcaacacattgggtcgaagattgtcggtggtacctacaccccggatgacgagtcgggcgatgcacgaaagttcacccagcagctggctcagcgctgtgcctctgcgggcatcgtcttccgttatgggagcacgattgccgccatccaggccgaagccggaaaaatcagcggggttcgcttggccggcagcgaggtgctgacggcagatgcctatgtattggcgctgggcagctatgcaccactattgacggcccccttgggcatgtccttgccggtgtatccggcgaagggttactccatcactattcccttggccgaggggagtggggcgccgaccgtcagcctcaccgacgacggttacaagctggtgtattcccgccttgggcagcgcctgcgggtagcggggacggcagagttttgtggttacgacaccagcctcaaccgggcaaggctggaggccttgaaggtacggacgaaggaagtgtttcccaccttgaaggcagccggcgaaatagaggagtgggccggcttgcggcccgctacgccggggaacgtgcctttgattggcgccagtcgctatcccaatctcttcctgaatgtcggacacggcaccctgggatggactctggcctgcggttcggggcaattgttggctgacttggttagcgggcgggaaccggctattgacccggttcgttatcggccctga

SEQ ID NO: 660 - protein, 414 aa, Unknown
  Obtained from environmental sample
  DOMAIN (2)...(399): FAD dependent oxidoreductase
  SITE (43)...(46): N-glycosylation site. Prosite id = PS00001
MRVIVLGAGVIGVTSAWYLAQAGHEVTVVDRQPDAGLETSFANGSQISVCHAEPWANPAVFSKLLRWLGREDAPLLWRFRWDPAQWAWGLRFLAQCGPTRTRQNIEALVALGLHSRASLQSLRTELNLQYDQLEKGILHFYTDAREFEHARPQAELMTQLGCPRRVVSTAECLALEPALQHIGSKIVGGTYTPDDESGDARKFTQQLAQRCASAGIVFRYGSTIAAIQAEAGKISGVRLAGSEVLTADAYVLALGSYAPLLTAPLGMSLPVYPAKGYSITIPLAEGSGAPTVSLTDDGYKLVYSRLGQRLRVAGTAEFCGYDTSLNRARLEALKVRTKEVFPTLKAAGEIEEWAGLRPATPGNVPLIGASRYPNLFLNVGHGTLGWTLACGSGQLLADLVSGREPAIDPVRYRP

SEQ ID NO: 661 - DNA, 1188 bp, Unknown
  Obtained from environmental sample
atgaagcgttcggttcagcggcgtcaggtagtgctcggaagcggtgcagccctattggtcggagcgctggacggctgcgcaggctctattcgcaccctgcagtcccctgcaccggccggccccaccttacagctcccacccctgcacgcgactacagatcggataactgtcatcaccgtctgtacgcggccgtttcgcccacagggtccccggctcgaagtggagcaagtcggacagaaggtcgtcgttcacaactacggccatggtggcagcggctggtcgctgtcgtggggatcgagcacactcgccactgagaaggccctcgcgaccggcgagcgcgacatcggagtcatcggctgcggagccctggggatgacctctgccctgctcctgcaacgcgccggcgcgcgggtcaccatctacgccaaagacttgccacccaacgttcgctcgtcgttggcaacgggtgtctttacgcccgactcgcggatctgcttcgaaccaaacgcaactgcggccttcaagcagcaatgggcgaagatggcgcgaacgtcgtaccaaacttatcagacactgctgggtcttccgggagacccggtcgagttcatcgacaactatgcggtggtcgacgaggagcggcctcccgcacatacacctgctgcacgagactcccgtccggcctttgcggagctccagcgtgagttgctcccggatctgttgccagtggaggagcgattcgcacctggtagtcacccgttcgggagaaggtacgcccggcgggcgcccatgatgatgttcaatcttgccgcctactctcggatgctcctatccgacttcctgcagaacggcgggcgcatcgtcatcgacgagtttcattcaccggcagacttcactcgactgcgggagaagacgctgatcaatgcaacgggctatggcgcacgcgctctgttcaacgatcagtccataacgccggtgcgaggacaactcgcacgcatgattccccaaccggaagtacgctacgggctcgagtatcggaatgtctatttcgtgccgcgtcgcgatggtctcgtatttcaggttggtggcgaagatgactactacggcttcggcgacgacacggctgcacccgatcgggccgaggcggagttggcagtcaagacgatcgctactctcttcagccccacctga

SEQ ID NO: 662 - protein, 395 aa, Unknown
  Obtained from environmental sample
  DOMAIN (114)...(391): FAD dependent oxidoreductase
  SITE (171)...(174): N-glycosylation site. Prosite id = PS00001
  SITE (311)...(314): N-glycosylation site. Prosite id = PS00001
MKRSVQRRQVVLGSGAALLVGALDGCAGSIRTLQSPAPAGPTLQLPPLHATTDRITVITVCTRPFRPQGPRLEVEQVGQKVVVHNYGHGGSGWSLSWGSSTLATEKALATGERDIGVIGCGALGMTSALLLQRAGARVTIYAKDLPPNVRSSLATGVFTPDSRICFEPNATAAFKQQWAKMARTSYQTYQTLLGLPGDPVEFIDNYAVVDEERPPAHTPAARDSRPAFAELQRELLPDLLPVEERFAPGSHPFGRRYARRAPMMMFNLAAYSRMLLSDFLQNGGRIVIDEFHSPADFTRLREKTLINATGYGARALFNDQSITPVRGQLARMIPQPEVRYGLEYRNVYFVPRRDGLVFQVGGEDDYYGFGDDTAAPDRAEAELAVKTIATLFSPT

SEQ ID NO: 663 - DNA, 1245 bp, Unknown
  Obtained from environmental sample
atggcgcggacggatgcaatcgttctgggtgccggcattgtcggcacgtcggttgcgctgcaccttgcgaaacgcgggatctcggttgcgctgatcgacaagcgggggccgggcgaggagacgagctacggcaacaccggcgtgatcgtcggcgccagcgtgtttccgaccgcgtttccgcgcaacctgaaaaagatcatccaggtcgcgctcaagcgcacgcccgaagcgaactatcactggggcgatctcctcaagatcgcgccatggctgatctcctattacggcttctcgacccctgagaaactgaaggacagtgcgctcaagctgcgtccgctgatgagccgcgcgcttgccgaacacaaactcctgatcgaggaatccggtgcgcagaaatatctgcgcgagaccggctggatgacgctttatcgcagcgacaagtcattcgaggcgatgaaaccgcaactcgaattcggcgccgagatcggtgttgcggcaaatccgctcgataccgaaggggcgttggcgctggagccgtcgctcgcgccggtgtttcgccatgcgctgctgtggcccgacgtcgcctcactctcgaacccactgatggtgacgcgcgcttacgcggcgcggttctcggcgctcggcggcgtgttcgtgaatggcgatgcgcgctcgctgcatcgctccgacggccgctggcgcgtcgacaccgagaacgggccggtcgattcgtccgaagtcgtcgtcgcgctcgggccgtggtcgaccgatgtgctggagccgctcggcatcaaggtgccgctcgggatcaagcgcggctatcaccgccatttcaacgcgaagggaaatgcctcgctctcgcgtccgatcatcgataccgaaatcggctatgcgctgaccccgatggagcagggtatccgcctgaccaccggcgcggagttcgcggcgcgcgacgcggcgccgaccccggtgcaattcgaccggttgatgccgagcgcaaaggagctgtttccgctcggcgagccgaacgaggccgagccgtggctggggcggcgtccgaacacgccggactcattgccgttcctcggccgcgctccggggcagcaggggctgtggctcgcgttcggtcacggccactggggagtgacgatgggcgccgtgaccggtcggctgatagccgaactggtgaccggcgcgacgccgttcgccgatccggcgccgtatcgggccgagcggttcatgtag

SEQ ID NO: 664 - protein, 414 aa, Unknown
  Obtained from environmental sample
  DOMAIN (5)...(395): FAD dependent oxidoreductase
  SITE (287)...(290): N-glycosylation site. Prosite id = PS00001
MARTDAIVLGAGIVGTSVALHLAKRGISVALIDKRGPGEETSYGNTGVIVGASVFPTAFPRNLKKIIQVALKRTPEANYHWGDLLKIAPWLISYYGFSTPEKLKDSALKLRPLMSRALAEHKLLIEESGAQKYLRETGWMTLYRSDKSFEAMKPQLEFGAEIGVAANPLDTEGALALEPSLAPVFRHALLWPDVASLSNPLMVTRAYAARFSALGGVFVNGDARSLHRSDGRWRVDTENGPVDSSEVVVALGPWSTDVLEPLGIKVPLGIKRGYHRHFNAKGNASLSRPIIDTEIGYALTPMEQGIRLTTGAEFAARDAAPTPVQFDRLMPSAKELFPLGEPNEAEPWLGRRPNTPDSLPFLGRAPGQQGLWLAFGHGHWGVTMGAVTGRLIAELVTGATPFADPAPYRAERFM

SEQ ID NO: 665 - DNA, 1263 bp, Unknown
  Obtained from environmental sample
atgaagtcggtcgcaatcatcggcgccggtctcgccgggctcgctaccgcctattggctccggcgccacggcgtgtcggtgacggtcgtggacaagcgccaggctccgggcgaaggcaccagctttgccaacggcggcatgctgaccccgagccaggccaatccgtggaacagccccgacacgtccgcccatttcctcggctggatcggacgcaaggaatcgccgctggcgatccggccatcggctctgccgggcctcgcgggatggggtgtgcgcttcctgctcgaatcgcttccgagccgttatcgacgcaacacggcgagcaacctcgcgctcggcagctacagcctggacatgcacaaggcgctggttgccgagaccaatctgcaattcgatcgtgctcgcgtgggcacgctgcagatcttccgctcgcaacccgcgttcgacgaaggcatgcgcgccgccggattcttgcgcgaccgcggcatcgccgtccggccgctcgacgctgcggcgacgctcgagctcgcgcccaccctgcgggagagccgcctgcgactcgccggcggcatccacttcccggaggacgaaagcggcgatgctcttctgttctgccgcgcactggcccgctacctgcaagcggacggcgtgacgctcgtatatggggccgacatcacggggatcgccgcggaagggcccacggtgcgcgccctggtatcgtcgcacgatcgcatcgacgccgacgccttcgtggtcgcagcgggacccggctcgaatgccctgctgcgccactgcggtattcattcacccatctatcccgtgaagggctactcgctcacctgcgacatcgcggggctgagctcggtaccggcgattccgctcgtcgacatggggcgcaagatcgcgctcacgccgctcggagaccggctccgtatcgccggcaccgcggaattcggcggttacgacaccaacctcgacgaacgacggctcggcagcattcttcgaaatgcctgcgaaatcatgccggcgctccgcaatgtcccggccgcgaagttttcgcggtgggcgggcctgcgcccagtcacgccgaccggattcccgatgctcggccgcacccggctcgacaacctgttcaccaatgccggccacggcccgctcggctggaccttcgcggccggtactggaaagatcgtcgccgatatcatcgcgaccggaacccacgacttggcaacggtcaccgccgtcggaggcagaatcccatga

SEQ ID NO: 666 - protein, 420 aa, Unknown
  Obtained from environmental sample
  SIGNAL (1)...(17)
  DOMAIN (3)...(401): FAD dependent oxidoreductase
MKSVAIIGAGLAGLATAYWLRRHGVSVTVVDKRQAPGEGTSFANGGMLTPSQANPWNSPDTSAHFLGWIGRKESPLAIRPSALPGLAGWGVRFLLESLPSRYRRNTASNLALGSYSLDMHKALVAETNLQFDRARVGTLQIFRSQPAFDEGMRAAGFLRDRGIAVRPLDAAATLELAPTLRESRLRLAGGIHFPEDESGDALLFCRALARYLQADGVTLVYGADITGIAAEGPTVRALVSSHDRIDADAFVVAAGPGSNALLRHCGIHSPIYPVKGYSLTCDIAGLSSVPAIPLVDMGRKIALTPLGDRLRIAGTAEFGGYDTNLDERRLGSILRNACEIMPALRNVPAAKFSRWAGLRPVTPTGFPMLGRTRLDNLFTNAGHGPLGWTFAAGTGKIVADIIATGTHDLATVTAVGGRIP

SEQ ID NO: 667 - DNA, 1113 bp, Unknown
  Obtained from environmental sample
ttggacggaaccgacctcgataggcgcgccgcgctaggtctcggcttgggagctgcggcgggtctcgttacgcgttccgaaccggcgagagcgttcgactccgtcacggcgctaccccggctcaaggtctcgcccgaactgatcctgcgccaagtcgccgggttgcgcccgttcaggccgtcgggcttcctcgtcaagagcgagccgctaggcagcaaaatcatcgtgcacaattatgggcatggcggatgcggtgtcaccctgtcctggggaacggccgatatggcggccaggcttgctctcgccacgccgcaccgaaaggctgccgttatcggctgcggagtcatcgggcttaccacggcgcggctgctacaggaccgcggtttcgacgtggccatctatgccgccgagctgccgcccgacaccacatcggatgtggccgccggcgccttcggcgtcacctcgctggtcgacgatcagcatcgcacgccggaaatcacgggcttgattcaggaggcggtgcgctttgcctacagatatttcgaggctctaatcggcggccgatacggcgtgcgctggatggacttctacatgctgagcgcagaaccggtggagttgccttgggagttctcaattacgcccgagctttttcccctcacgaaattcggtccgggcgagcatccttttccctcgccttacgccggcaggttcagaaccatgatcgccgaaaccgacatattcttgccggcgctcatggacgacgtacgtaaaggcggcgccaccatcgaagtccgcaaattcaccgacctttccagcttgcaatcgctcgacgcgccgctgatcgtcaactgcacgggtctcggcgccaaggccctgttcggcgatccggtgcttacgccggtcaaggggcagctcaccgtgttgcgaccccagcccgatgtgacttacgcctatctcgacggcgtgctcgatttctacatgttctcgcgcagcgacgggatcgtgctgggcgggagtcatggcgaaggggtctggtcgacggacatcgacggcctccgcgcggcgcaaatcctcgagggccacgcgctcatcgccggcggcatgcggtcatga

SEQ ID NO: 668 - protein, 370 aa, Unknown
  Obtained from environmental sample
  DOMAIN (107)...(369): FAD dependent oxidoreductase
  SITE (76)...(94): D-amino acid oxidases signature. Prosite id = PS00677
  SITE (287)...(290): N-glycosylation site. Prosite id = PS00001
MDGTDLDRRAALGLGLGAAAGLVTRSEPARAFDSVTALPRLKVSPELILRQVAGLRPFRPSGFLVKSEPLGSKIIVHNYGHGGCGVTLSWGTADMAARLALATPHRKAAVIGCGVIGLTTARLLQDRGFDVAIYAAELPPDTTSDVAAGAFGVTSLVDDQHRTPEITGLIQEAVRFAYRYFEALIGGRYGVRWMDFYMLSAEPVELPWEFSITPELFPLTKFGPGEHPFPSPYAGRFRTMIAETDIFLPALMDDVRKGGATIEVRKFTDLSSLQSLDAPLIVNCTGLGAKALFGDPVLTPVKGQLTVLRPQPDVTYAYLDGVLDFYMFSRSDGIVLGGSHGEGVWSTDIDGLRAAQILEGHALIAGGMRS

SEQ ID NO: 669 - DNA, 1260 bp, Unknown
  Obtained from environmental sample
atggctcgaacggacgctatcgtgctgggcgccggtatcataggcacctcgatcgcgctgcatctggtcaagcgcgggctgtccgtcgcgctggtggaccggcgcggaccgggcgaggagacctcctacggcaattccggtgtgatcgagggcaacacggtcttcccgcacccgttcccgaccactctgtcgtcgctgctcaagatcgcgctcaagcaggcgccggaagcgaactatcacatcgcggatttgccgcagctcgcgccatggctcctggcctaccgtcacaacacccagcttgccggcagcctcgcctttgccgagtcgatgcggccgctgttcggccgggcgctcgccgagcacgaggccctgatgacggaatccggcgcgacgcggtatctgcgcaaggatggctggctcaagctctaccgcagcgaaggcccggacgcccggcagtcggccgagctcgagcttgcctcgaagttcggtctgccgttccggatgctcgacaccgaaggtgcgcgcgcgctcgagccgtcgctcgcgccggtgttccgccgcgcggtgcattggccgaacgccgcgagcgtctccaatccgctcgccgtcaccaaggcctatgtggcgcagtatgtcctgctcggcggcctggtgctcaagggcgacgcgcgcacgctgcatcgctccggcaccggctggcgcatcgacaccgaagaaggcgcgctcgacaccaaggacgtggtggtggcgctcggaccctgggcgcccgatgtgctggagcctctgggagtccgtctgccgctcgcggtcaagcgcggctatcaccgccacttccggccggtcggcaacgccggcctgacgcgccccgtggtcgacaacgacaacggctatctgctggcgccgatggagcagggcatccggctcaccaccggcgccgaattcgcccgccgcgatgcgccggcgacgccggtgcagttcgaccggctgctgccggccgccagggccctgttcccgctcggcgagcccgccgaggccacgacctggatgggttcgcgcccgagctttgccgattccatgccggtgatcgggcaggctccgggacagaccggactgtggctcgcctatggccatgcccattggggcctgacgctcggtccggtgaccgggcgcctcgtcgccgacctggtgacgggctcagcgccgttctgcgatcccaagccctacgcggcctcccgtttcgggaacgatcgttcggcatga

SEQ ID NO: 670 - protein, 419 aa, Unknown
  Obtained from environmental sample
  DOMAIN (5)...(395): FAD dependent oxidoreductase
MARTDAIVLGAGIIGTSIALHLVKRGLSVALVDRRGPGEETSYGNSGVIEGNTVFPHPFPTTLSSLLKIALKQAPEANYHIADLPQLAPWLLAYRHNTQLAGSLAFAESMRPLFGRALAEHEALMTESGATRYLRKDGWLKLYRSEGPDARQSAELELASKFGLPFRMLDTEGARALEPSLAPVFRRAVHWPNAASVSNPLAVTKAYVAQYVLLGGLVLKGDARTLHRSGTGWRIDTEEGALDTKDVVVALGPWAPDVLEPLGVRLPLAVKRGYHRHFRPVGNAGLTRPVVDNDNGYLLAPMEQGIRLTTGAEFARRDAPATPVQFDRLLPAARALFPLGEPAEATTWMGSRPSFADSMPVIGQAPGQTGLWLAYGHAHWGLTLGPVTGRLVADLVTGSAPFCDPKPYAASRFGNDRSA

SEQ ID NO: 671 - DNA, 1242 bp, Unknown
  Obtained from environmental sample
atggatttcgacgtaatcgtattgggcgccggcattgtcggcgtgtcggccgcgctgcatctgcaggatcgcggacgccgcgtcgcgctggtcgatcggcgcgggcccggtgaggaaaccagtttcggcaacgcggggttgatcgagagttcgtcgatcgtgccgtacggttttccgcgccggctcggcacgctactgcgctacgcgcgcaatcaatcgaccgatctctactgggactaccgggcgcttcccgcattcgccggatggctggggcgtttctggtgggagtcatcacccgagcggctggcggcagcggcgcgcgatatgttgccgttgatccgccagagcgtcgccgaacacgatgcgctgatcgcgcgcgcgggcctcgaatcgctcgcgcacgacggcggatggatcgaagcgtttcgcacgcaaagcgaactggatcatcagacggcggcggccgagtccgccgtgcgcgacctcggtctgcgcgtcgtgcctctcgatgcggccgcgttgtgcgcgaaagaaccgagcatcaatcgcggcttttgcggtgcgttgcactggcaggacccgaagagcatctccgatccgggcgcgctgacgaaaggctatgcgcgtctcttcgaacagtccggcggcacgttgctgaccggcgacgccgcgacgctgcgcgcgcgaggcgacgggtggaccgtgcagagcagcgtcggcgaaatcagcgcgagggaagtggtggtcgcgctcggaccttggtcggacacggtgttcgcaccactcggctatcgcattccgctgcgcgcgaaacgcggctatcacatgcactatcggcccacgcagacggtgttgtccgtccccgtggtcgacaccgaggaaggctacgtgattgcgccgatgcgaggcggcttgcggctcaccaccggcgttgaaattgcgcgtcgcgaggcagcgcccacggggattcaactcgaacgcgccgaacgtatcgccaaaccgctgttcggtttgggcgagcgtgtagacgaggcgccgtggctcgggctgcgtccgtgcacgcccgacatgcggccggtgatcggacgcgcgccccgccatcgcgggctgtggttttcgttcggacataaccatcacggcttgacgctcggacccgtcaccggacgtttgctcgcggaaatgatgacgggcgcgactccgttcatcgacgtgcggccgtttcgtccggagcgattccggtag

SEQ ID NO: 672 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSAALHLQDRGRRVALVDRRGPGEETSFGNAGLIESSSIVPYGFPRRLGTLLRYARNQSTDLYWDYRALPAFAGWLGRFWWESSPERLAAAARDMLPLIRQSVAEHDALIARAGLESLAHDGGWIEAFRTQSELDHQTAAAESAVRDLGLRVVPLDAAALCAKEPSINRGFCGALHWQDPKSISDPGALTKGYARLFEQSGGTLLTGDAATLRARGDGWTVQSSVGEISAREVVVALGPWSDTVFAPLGYRIPLRAKRGYHMHYRPTQTVLSVPVVDTEEGYVIAPMRGGLRLTTGVEIARREAAPTGIQLERAERIAKPLFGLGERVDEAPWLGLRPCTPDMRPVIGRAPRHRGLWFSFGHNHHGLTLGPVTGRLLAEMMTGATPFIDVRPFRPERFR

SEQ ID NO: 673 - DNA, 1242 bp, Unknown
  Obtained from environmental sample
atggatttcgacgtaatcgtattgggcgccggcattgtcggcgtgtcggccgcgctgcatctgcaggatcgcggacgccgcgtcgcgctggtcgatcggcgcgggcccggtgaggaaaccagtttcggcaacgcggggttgatcgagagttcgtcgatcgtgccgtacggttttccgcgccggctcggcacgctactgcgctacgcgcgcaatcaatcgaccgatctctactgggactaccgggcgcttcccgcattcgccggatggctggggcgtttctggtgggagtcatcacccgagcggctggcggcagcggcgcgcgatatgttgccgttgatccgccagagcgtcgccgaacacgatgcgctgatcgcgcgcgcgggcctcgaatcgctcgcgcacgacggcggatggatcgaagcgtttcgcacgcaaagcgaactggatcatcagacggcggcggccgagtccgccgtgcgcgacctcggtctgcgcgtcgtgcctctcgacgcggccgcgttgtgcgcgaaagaaccgagcatcaatcgcggcttttgcggtgcgttgcactggcaggacccgaagagcatctccgatccgggcgcgctgacgaaaggctatgcgcgtctcttcgaacagtccggcggcacgttgctgaccggcgacgccgcgacgctgcgcgcgcgaggcgacgggtggaccgtgcagagcagcgtcggcgaaatcagcgcgagggaagtggtggtcgcgctcggaccttggtcggacacggcgttcgcaccactcggctatcgcattccgctgcgcgcgaaacgcggctatcacatgcactatcggcccacgcagacggtgttgtccgtccccgtggtcgacaccgaggaaggctacgtgattgcgccgatgcgaggcggcttgcggctcaccaccggcgttgaaattgcgcgtcgcgaggcagcgcccacggggattcaactcgaacgcgccgaacgtatcgccaaaccgctgttcggtttgggcgagcgtgtagacgaggcgccgtggctcgggctgcgtccgtgcacgcccgacatgcggccggtgatcggacgcgcgccccgccatcgcgggctgtggttttcgttcggacataaccatcacggcttgacgctcggacccgtcaccggacgtttgctcgcggaaatgatgacgggcgcgactccgttcatcgacgtgcggccgtttcgtccggagcgattccggtag

SEQ ID NO: 674 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSAALHLQDRGRRVALVDRRGPGEETSFGNAGLIESSSIVPYGFPRRLGTLLRYARNQSTDLYWDYRALPAFAGWLGRFWWESSPERLAAAARDMLPLIRQSVAEHDALIARAGLESLAHDGGWIEAFRTQSELDHQTAAAESAVRDLGLRVVPLDAAALCAKEPSINRGFCGALHWQDPKSISDPGALTKGYARLFEQSGGTLLTGDAATLRARGDGWTVQSSVGEISAREVVVALGPWSDTAFAPLGYRIPLRAKRGYHMHYRPTQTVLSVPVVDTEEGYVIAPMRGGLRLTTGVEIARREAAPTGIQLERAERIAKPLFGLGERVDEAPWLGLRPCTPDMRPVIGRAPRHRGLWFSFGHNHHGLTLGPVTGRLLAEMMTGATPFIDVRPFRPERFR

SEQ ID NO: 675 - DNA, 1242 bp, Unknown; identical to SEQ ID NO: 673
  Obtained from environmental sample

SEQ ID NO: 676 - protein, 413 aa, Unknown; identical to SEQ ID NO: 674
  Obtained from environmental sample
  DOMAIN (4)...(394): FAD dependent oxidoreductase
  SITE (72)...(75): N-glycosylation site. Prosite id = PS00001

SEQ ID NO: 677 - DNA, 909 bp, Unknown
  Obtained from environmental sample
atgcacgaggtgacggtggtcggcgcgggcgtggtggggctgaccaccgcgctcgtcctccaggagtcgggacaccgggtcagggtcgtcgccgccgagcgtccggagcagacgacctcggccgccgccggtgcggtctggtatcccttctcggtcgggcctccggaggccgtgaaccgctgggcccggaccacccgggactggctgctcaggctgcatcgcactgtgccgtccgcgggcgtggacgtgatcaccgtccgggagtgcgccgccgacgcgcggcgtccctggtgggcagacgtggtcgagggccggctcgtcgagggaccgcagccgaccggggcacgacttgcctgggagttcgaggcgccccgcgtggagccggcgctgcatctctcctggctcgagtcgcagctggagcagccgatcgagattgcccgggtcgagcggctggaggacgtgcctggcgacctggtggtgaactgcactggcatcggggcacgacggctgggcggtgacggcagcctgcgggcgctgcttggccagaccgtggtggtggccccgggtgaggtcgacatgcagtgcatgttcggagacgagcgggacctctcggtgatgctctacgtgattccccgccgggccgaggtggtcctcggcgggtgcgctctgccgttcgacggcgacgtttcgcctccgccagacccggcgcttcgcgcggcgatcctcgcgcgggtgcgtgcggcggggttccggcatggacccgtgctccgcgacgcggtggggctccggccggtccggcccgaggtccgcgtcgagcgggtcgggcgcgtcattcaccactacgggcacggcggagctggctacactctggcccgcggctcggcagcgcaggtcatcgactcgatctga

SEQ ID NO: 678 - protein, 302 aa, Unknown
  Obtained from environmental sample
  DOMAIN (3)...(301): FAD dependent oxidoreductase
  SITE (163)...(166): N-glycosylation site. Prosite id = PS00001
  SITE (281)...(299): D-amino acid oxidases signature. Prosite id = PS00677
MHEVTVVGAGVVGLTTALVLQESGHRVRVVAAERPEQTTSAAAGAVWYPFSVGPPEAVNRWARTTRDWLLRLHRTVPSAGVDVITVRECAADARRPWWADVVEGRLVEGPQPTGARLAWEFEAPRVEPALHLSWLESQLEQPIEIARVERLEDVPGDLVVNCTGIGARRLGGDGSLRALLGQTVVVAPGEVDMQCMFGDERDLSVMLYVIPRRAEVVLGGCALPFDGDVSPPPDPALRAAILARVRAAGFRHGPVLRDAVGLRPVRPEVRVERVGRVIHHYGHGGAGYTLARGSAAQVIDSI

SEQ ID NO: 679 - DNA, 1161 bp, Unknown
  Obtained from environmental sample
atgatgatggatgcacaggttttcgatttcgccgtggtcggcgcgggcatggccggcgcctcggtggcctaccggctggcgcgttccggcgcctcggtgctggtgctcgagcgcgaggcgcagccgggctaccactccacgggccgttcggccgccatgttcatggaaagctacggcaccgagcagatccgggcgctgacacgcgccagccgcgccttctacagcgcgccgcccgaggggttctgcacgcatgggctgctgcagccgcgcagcgtgctctacgtgggcaccgaaggacaggagtccctgctggacgaggccctggccatgtaccgccgcgacggcctgcgcgccgagcgcataggccccgaacaggcccatgccctggtgccctgcctggatgcgcggcagctcgtgggggccgtgcatgacatggacgccatggacatcgacgtggccgagctgcaccagggctttttgcgcggcatggcgcgcgcgggtgcccggctgcgctgcgaggccgatctcgccggcgcccggcgcgatgacgcggcccatggccagggggtctggacgctgaccctgcgcgacggcagccgcctgcgcgcccgcgccgtggtcaatgccgcgggggcctgggccgatgccgtggcccgcctgtgcggggcccggcccctgggcatagaaccgcggcgccgctcggccttcaccttcgccgcgcccgagggactgcccatccatgactggcccgccgtgatcggcgtggacgagagcttttacttcaagcccgacgcgggccaactgctggggtcgccggccaacgccgatcccgttccggcccacgacgtggccgccgaggagctggacgtggccacgggcatccaccgcatagagtcgctgaccagcctgcgcatacgccggccccgccatgtctgggccgggctgcgcagcttcgcgcccgacgatgacttcgtgatcggctgggacacggggtgcgacggctttttctggctggcggggcagggcggctacggcatacagacggccgccggcgcctcggccgccgccagcgcgctgctgctgggccgggagctgcccgaggagctcagggcccagggcgtcgatgcccggcgcctgagccccgcgcgcttcgccgcctga

SEQ ID NO: 680 - protein, 386 aa, Unknown
  Obtained from environmental sample
  DOMAIN (9)...(359): FAD dependent oxidoreductase
MMMDAQVFDFAVVGAGMAGASVAYRLARSGASVLVLEREAQPGYHSTGRSAAMFMESYGTEQIRALTRASRAFYSAPPEGFCTHGLLQPRSVLYVGTEGQESLLDEALAMYRRDGLRAERIGPEQAHALVPCLDARQLVGAVHDMDAMDIDVAELHQGFLRGMARAGARLRCEADLAGARRDDAAHGQGVWTLTLRDGSRLRARAVVNAAGAWADAVARLCGARPLGIEPRRRSAFTFAAPEGLPIHDWPAVIGVDESFYFKPDAGQLLGSPANADPVPAHDVAAEELDVATGIHRIESLTSLRIRRPRHVWAGLRSFAPDDDFVIGWDTGCDGFFWLAGQGGYGIQTAAGASAAASALLLGRELPEELRAQGVDARRLSPARFAA

SEQ ID NO: 681 - DNA, 1266 bp, Unknown
  Obtained from environmental sample
atgcgtattgtcgtgattggcgcgggactgcccggagtgacgaccgcctgttttcttgcccaggccggtcatgatgtgatcgtgcttgatcgccgggaagggcctggccttgaaaccagctttgccaatggcggtatgctgacaccgagccaggccgctccctggaattctcccgggattgcgctacaggtgctcaaatggatcggtcgcgaagaatccccattcctgctcaagctgtctgaaattcccgcgttgattggttggggcagtgcgtttttgcgccattcccgggccgagcgatttctcaaaaaccagtttagcaatgcaatgctggcccgttacagtcttcagcaactgggccagctgcgtcagtcgcttggtttgcaatacgatcagtccacacgcggtacgctgaagatttaccggaccgttgcggcgcgagagcaggccgtacgtgagttgctgacggcaggcatcaaggagatacattatcaggtactcgacgcgcaaggcgtgactgcaattgaacctgcgctggagccggtcagcaagatgttggcaggcggtatttatttcccggacgatgaagcgggtgatgcccactactattgccgccaggtggccgaggctgccgcaacagcgggagcaagattcatgtatggaaccggggtgacagggctggcgcagactgcgaaccgcctgtccgcggtgaagacctctggtggggatatcgaggcagatctgtatattctcgctgccggttgttatagcccggtgctggcacggactgtaggtctgcacctgcccatttatccggtgaagggatattcgctgaccattgataccggacattgcaagggtgcattgccgctgttaccggtcattgatgagttgcgccatgttgctgtcacaccgtttgcaaaccgtttgcgtattgccggcaaggcggaacttgccggttacgataccggtatcgacgatcatcggattgcactattgctgaaattcttcagacaaatctatccacaagcaggggcgcaaatcagcgattctgaggtccggaagtgggccggtttgcgtccttacagttgtgacggcgtcccgattctcgggccatgccggctggataatctgcttctgaacaccggtcatggccatcttggctggacgctggcggctggttcggccaggttgattgcggaccatgtagccggtcatgcaacagcgctcgatttaagcccctatctgttgtcacgattcaactga

SEQ ID NO: 682 - protein, 421 aa, Unknown
  Obtained from environmental sample
  SIGNAL (1)...(22)
  DOMAIN (2)...(402): FAD dependent oxidoreductase
MRIVVIGAGLPGVTTACFLAQAGHDVIVLDRREGPGLETSFANGGMLTPSQAAPWNSPGIALQVLKWIGREESPFLLKLSEIPALIGWGSAFLRHSRAERFLKNQFSNAMLARYSLQQLGQLRQSLGLQYDQSTRGTLKIYRTVAAREQAVRELLTAGIKEIHYQVLDAQGVTAIEPALEPVSKMLAGGIYFPDDEAGDAHYYCRQVAEAAATAGARFMYGTGVTGLAQTANRLSAVKTSGGDIEADLYILAAGCYSPVLARTVGLHLPIYPVKGYSLTIDTGHCKGALPLLPVIDELRHVAVTPFANRLRIAGKAELAGYDTGIDDHRIALLLKFFRQIYPQAGAQISDSEVRKWAGLRPYSCDGVPILGPCRLDNLLLNTGHGHLGWTLAAGSARLIADHVAGHATALDLSPYLLSRFN

SEQ ID NO: 683 - DNA, 1251 bp, Unknown
  Obtained from environmental sample
atgaacgttcttgttgtaggcgctggagtggttggtaccagcacggcgctgagcctgaccgaacgcgggttccaggtcaccgtcctggaacgccatgctgaggttgccgctgaaaccagtcatgccaacggcggcggggtcaccccgggccacgccgagccctggaatgcccctggcatcatcaagcgcctgctgactcgatctggtgccggtgagccgtttcggctccatgcccatgctctgccggggctgattgaatgggggctaagctttctatggcagtcgaaggcatcacgctactacgccaatgccagaaacaacacgcggctggcggtgtattccggtgagtgcctgaagcgcctgcgccagcgccatgaactgagctatcaccagtacaccgagggttcgctggagctgtacttcagccgctcggagctggataatgcgctggatctgcgtcgcaagatcggcgatcctggcgtagagatccggatcattgatgtcaacgaagtcctggctatggagccggcgcttgagccggtggccggtcgtatggccggtgccttgctgctgccgctgcacgagtctggcgatgcctgcgctttttcagccgagatgctgcgctgcgctgaacagttgggggccaatgtccgactgggtgctgatgtcgagcgcatcgaacagcacaagggccgggtagttggcgttcgcctcaaaggcggtcagctgattgaggcggacgcggtagtcgtggccgccggctgtagctcgcctgcgctggtcaaaccgctgggcttgcgtctgccgatctatccagtcaagggctactcggcgacgctggcgctcgagcaggccgatctggcaccgaccatcccgttgctggacctggagcatcgcatcgttaccgcccgcttcggcaaccgtctgcgcatggccggcctggccgactttgatggccacaatcgcggtatacgacccgaccgactggaactgctgctggaatctgcttgtgccctgctgccgcgcctggccgacgaaatccggtccggccgcgccgaagcctggaccggcctgcgcccgatgacgcccaagggcccgcccttgatcggacccactagcattccagggttgttcctaaacaccggccacggcgccatgggctggacccaggccgctggctcggccgatctgatggccgacttgctggctgaaaaatccctcgctatcgatctcgccccttacgccccctga

SEQ ID NO: 684 - protein, 416 aa, Unknown
  Obtained from environmental sample
  DOMAIN (2)...(401): FAD dependent oxidoreductase
  SITE (107)...(110): N-glycosylation site. Prosite id = PS00001
MNVLVVGAGVVGTSTALSLTERGFQVTVLERHAEVAAETSHANGGGVTPGHAEPWNAPGIIKRLLTRSGAGEPFRLHAHALPGLIEWGLSFLWQSKASRYYANARNNTRLAVYSGECLKRLRQRHELSYHQYTEGSLELYFSRSELDNALDLRRKIGDPGVEIRIIDVNEVLAMEPALEPVAGRMAGALLLPLHESGDACAFSAEMLRCAEQLGANVRLGADVERIEQHKGRVVGVRLKGGQLIEADAVVVAAGCSSPALVKPLGLRLPIYPVKGYSATLALEQADLAPTIPLLDLEHRIVTARFGNRLRMAGLADFDGHNRGIRPDRLELLLESACALLPRLADEIRSGRAEAWTGLRPMTPKGPPLIGPTSIPGLFLNTGHGAMGWTQAAGSADLMADLLAEKSLAIDLAPYAP

SEQ ID NO: 685 - DNA, 1281 bp, Unknown
  Obtained from environmental sample
atgaataagcggacacccgaacgggttgtcgtcattggtgggggcgtggttggtgccacgaccgcgctggcgttggccgagcgcggcctgcaggtcacactggtcgagcgtaatgccgaggtggccgaggagaccagccaggcgaatgggggtggcatcaccccggcgcactccgaaccctggaacgcgcctggactgctgggcaagctggtgcgcaatctcggccgtaccgatgccccctatcggctttcaccgctggcgctgccgggaatgggtttgtggggactgcgttttctcgccaacatgcgccgtgaacggttcatcggcaatgcccgcaacaacatccgcctcggtctgtattcactcgagtgcctgcgacgctggcgcgagcgctacgacatggaatatcgacagaccctgtccgggtccatgcaggtttacttctcgcgcgaattgatggccgagtcggtgcagttccggcgcgaactgcttcaggggagtgcgccgatcgagcccatcggcgtcgacgaagtcattgccagggagccggcgctggcgccggtgcgccgcgaactggccggcgcgatcgttttcgccgagcatgagtccggcgatgcgcgccggttcagccagctcgccgccgagctggcctctgcccagggagcccaactgcagttcgacacgactgtgcagtcgattcgccttgaaagcggtcgcctacgctcggtggtgaccgatcagggtgaaatcgaggccgatgcctgcgtgatcgcggccggggcggcatccgtgcaattggcacgcccgctcggtctgcacctgccgatctacccggtgcgcggttactcggccactttcgaaatcgaacgcagcgatgcacttccgactctgcccatgctcgataccgccaaccgcttcgtcaccctcagactgggcgagcatggcctgcgaatcgccggactggcggattttgctggccatcaccgccggatcgtgccgcggcgtatcgaatgcctgctggccggcgctcgccgcctgctgccggcactggccggcgagctggttgccgagcgggccgagttgtgggccggcttgcggccggtcactccggacggtccgccactactcggccagacccgagtgccgggcgtatacgtcaatgccggccatggacccatgggctggaccatggcctgcggatcggcagaactggttgccgcgagtctatgcggcgagcacaccacgatagatgcgggagcttaccgggtcgatcgcgcctga

SEQ ID NO: 686 - protein, 426 aa, Unknown
  Obtained from environmental sample
  SIGNAL (1)...(24)
  DOMAIN (8)...(408): FAD dependent oxidoreductase
MNKRTPERVVVIGGGVVGATTALALAERGLQVTLVERNAEVAEETSQANGGGITPAHSEPWNAPGLLGKLVRNLGRTDAPYRLSPLALPGMGLWGLRFLANMRRERFIGNARNNIRLGLYSLECLRRWRERYDMEYRQTLSGSMQVYFSRELMAESVQFRRELLQGSAPIEPIGVDEVIAREPALAPVRRELAGAIVFAEHESGDARRFSQLAAELASAQGAQLQFDTTVQSIRLESGRLRSVVTDQGEIEADACVIAAGAASVQLARPLGLHLPIYPVRGYSATFEIERSDALPTLPMLDTANRFVTLRLGEHGLRIAGLADFAGHHRRIVPRRIECLLAGARRLLPALAGELVAERAELWAGLRPVTPDGPPLLGQTRVPGVYVNAGHGPMGWTMACGSAELVAASLCGEHTTIDAGAYRVDRA

SEQ ID NO: 687 - DNA, 957 bp, Unknown
  Obtained from environmental sample
gtgcggatactcgtcatcggagccggggtctccggcctgaccaccggcctcctgttgctgcgcgacgggcacgagatcaccatatgggccaaagacgtgccgccgcacaccacgtccaaccgcgcggccgccgtgtggtatccctatcgcgccgcgccaatcgaccgtgtcacacgctggggcgcggccagctaccgcacgttcgtacgcatagctgcggaagagccagaggctggcatcctcgtttccaccgtcttcgacctgcgcgcggagcgtgacgacacactgcctgaatgggcatcggaagtgggcggggtacgccatgcgactgccgaagagctgccaccaggctacgccgatgccttcgtcttcgacacgccggtgatcgacacctcgatctatatgagctacctgcgcgcagcggtcgagcaggcaggcgggcggatcgagcagcgcgccgtagactctctggacgaagcgtttgccgcgtcgagtgtagtggtgaactgcgccggcctcggctcgcgcgagctgctgggcgacacggacgtgcacgcggcacggggacaggtggtgcgcgtgcggcataacgggtatcggcgcgtgctgctggacgactttggcccgaacgcgctggcatacatcgtcccacgcctgcacgacatcatcctcggcggcacggacgaagaggatcgcgaggacaccacccctgatcccgagcagacgcgcggcatcctgcaacgctgtgccaagctggcgcccgagttcgccggcatcaccgaagaggatattctcgaagtgcgctgcgggctgcgtcccctgcgctccacggtgcggctggagctggagcgtcccgcgccggatcgtatgctggtacataactacggccatggtggcgcgggcgtcacactctcatggggctgcgccgccgaggtggtggagctgctgcattcctga

SEQ ID NO: 688 - protein, 318 aa, Unknown
  Obtained from environmental sample
  DOMAIN (2)...(315): FAD dependent oxidoreductase
  SITE (295)...(313): D-amino acid oxidases signature. Prosite id = PS00677
MRILVIGAGVSGLTTGLLLLRDGHEITIWAKDVPPHTTSNRAAAVWYPYRAAPIDRVTRWGAASYRTFVRIAAEEPEAGILVSTVFDLRAERDDTLPEWASEVGGVRHATAEELPPGYADAFVFDTPVIDTSIYMSYLRAAVEQAGGRIEQRAVDSLDEAFAASSVVVNCAGLGSRELLGDTDVHAARGQVVRVRHNGYRRVLLDDFGPNALAYIVPRLHDIILGGTDEEDREDTTPDPEQTRGILQRCAKLAPEFAGITEEDILEVRCGLRPLRSTVRLELERPAPDRMLVHNYGHGGAGVTLSWGCAAEVVELLHS

SEQ ID NO: 689 - DNA, 1248 bp, Unknown
  Obtained from environmental sample
atggctcaggacgtgatcgtgctcggcgcgggcatcgtgggagtatgcgttgcgctgcatctgcaacaacgcggatggcaggtgacgctcgtcgaccgacacgcgcccggcgaggcgacgagcttcggcaatgcgggcctgatcgaggcgtcgtcggtcgtgccctatgcgtttccgcgcgactggcgcaccgtgctgaagttcgcgatgaaccgctcgaccgcgctgcgctacgacctgcgctcgctgccggcgtatgcgccgtggctcgcgcggttctggtgggagtcggcgcccgagcgtctcgccgccgccgcgcgcgacatgctgccgctcattcgacgcagcgtcgcggagcacgaggcgctcatctcgcgggcgggtctcgacgacctcgtgcggcccacgggctggctcgaagcgtatcgctcgcgcgaacagttcgaccatgaggtgagcgccgccgaacgaatcgcgcgcgagcacgggctcggcatgaaagtgctcgatgctggagcgctgcatcggctggaggcatcgctcgacggcgcatacgcgggtgcgatccactggacggacccgcgcagcgtgatcgatccgggagcgctgacgaaaggctatgctgcgctgttcgagcgcgacggcggacgcttcctgaacggagatgccgcgacgctcgaggcgtcgcgaagcggctggcgcgtgatgaccgggagcgggccggtcgaggcgcaggcggcggtcgtagcgctcggcttatggtccggcgatctcgcgcgcaggttcggataccgcgtgccgctcatggccaagcgcggctatcacatgcattacgagagcgatggacgcggcgcgctatcgaggccggtagtcgacatcgagaacggctatgtggtggcgccgatgcggcgcggcctgcgtctgaccaccggcgtcgagctcgcctgccgtaacaggccgccgagcccggtgcaattggagcgcgcggagcggcttgcaagacccgtgttcggcctcggggcccgggtcgacgaggcgccctggcttggcctgcggccttgcacgccggacatgcggccagtcatcgggcccgcggaccgccaccctggactctggttcgccttcggacacgcgcatcacgggcttacactcggaccggtcacgggaagactgcttggggagctgatgagcggggaagcgggtttcaccgatcctgtcccttatcgaatcggaaggttctcgcaatag

SEQ ID NO: 690 - protein, 415 aa, Unknown
  Obtained from environmental sample
  DOMAIN (4)...(395): FAD dependent oxidoreductase
  SITE (72)...(75): N-glycosylation site. Prosite id = PS00001
MAQDVIVLGAGIVGVCVALHLQQRGWQVTLVDRHAPGEATSFGNAGLIEASSVVPYAFPRDWRTVLKFAMNRSTALRYDLRSLPAYAPWLARFWWESAPERLAAAARDMLPLIRRSVAEHEALISRAGLDDLVRPTGWLEAYRSREQFDHEVSAAERIAREHGLGMKVLDAGALHRLEASLDGAYAGAIHWTDPRSVIDPGALTKGYAALFERDGGRFLNGDAATLEASRSGWRVMTGSGPVEAQAAVVALGLWSGDLARRFGYRVPLMAKRGYHMHYESDGRGALSRPVVDIENGYVVAPMRRGLRLTTGVELACRNRPPSPVQLERAERLARPVFGLGARVDEAPWLGLRPCTPDMRPVIGPADRHPGLWFAFGHAHHGLTLGPVTGRLLGELMSGEAGFTDPVPYRIGRFSQ

SEQ ID NO: 691 - DNA, 1239 bp, Unknown
  Obtained from environmental sample
atgaaaacaattgctgttcttggcgcaggtgtcacgggaataaccacagcctacgcccttcagaaacgcggatttgacgtctcaattatcgatcgccagcgctatgcggcgatggaaacatcctttgccaatggcggacaactatcggcctcgaacgccgaggtttggacgcgctggtctacggtgctcaaagggctcaaatggatgacccagcgcgacgcgccacttttgatgaacccctatcccacatggcataaatactcgtggattgctgagttcatggcctcgatcccaaaatactcagccaacacaattgaaacggcacggatggcgatacaggcgcgcgagccgcttttggcttgggcgaaagaggccggcgttgagttcgatccagaaatgcgcggaatattgcacatttaccgcagcaaaaaagagtttgaccacgcaaccatggtcaatggattgctcgctaaagcaggcctcgagcgccactctgtcacgccgaaggagatgctggagattgagccaacgctcaagggtgatttctatggcggttattacactgaaagcgattttacaggcgacatccataaatatactgttgggcttgcaaaggcctttgaggccaatggcggcaagctgttacttgaacgcgagataacgtccgcatctgctatcggtgacaaaggcgtagcggtgatggtgcgcactaagtccaatgagatcgaatcgcttagctttgattcctgtgtagtttgcgcaggtattggtagccgcgacatcgcgcgccagttgggggatcgggtcaatatttatcccgtcaaaggctattcaatcacggtcaatctatctgacaaagcgagccaaaaggcagcgccaaccgtgagccttcttgacgatgagacgaaacttgtctcctcgcgcctcggcaaagatcggctgcgcgttgcaggaacggcggagttcaacggctacaaccgcgatatccgggcagaccgcatcaagccgctggtcgattgggtgaatgccatttttcctgatgtgtcgactgaaacggtggtgccatgggcaggtctgcgccctatgatgccaagcatgatgccgcgcgtcgggcgtggaaaacatcagggtgtcttctacaacaccggccatggccatctcggatggacgctatcggcatgcacggcggagatgatctcggcacttgtagaagcgaacgcccactccaacgcgccatga

SEQ ID NO: 692 - protein, 412 aa, Unknown
  Obtained from environmental sample
  SIGNAL (1)...(19)
  DOMAIN (3)...(402): FAD dependent oxidoreductase
  SITE (286)...(289): N-glycosylation site. Prosite id = PS00001
MKTIAVLGAGVTGITTAYALQKRGFDVSIIDRQRYAAMETSFANGGQLSASNAEVWTRWSTVLKGLKWMTQRDAPLLMNPYPTWHKYSWIAEFMASIPKYSANTIETARMAIQAREPLLAWAKEAGVEFDPEMRGILHIYRSKKEFDHATMVNGLLAKAGLERHSVTPKEMLEIEPTLKGDFYGGYYTESDFTGDIHKYTVGLAKAFEANGGKLLLEREITSASAIGDKGVAVMVRTKSNEIESLSFDSCVVCAGIGSRDIARQLGDRVNIYPVKGYSITVNLSDKASQKAAPTVSLLDDETKLVSSRLGKDRLRVAGTAEFNGYNRDIRADRIKPLVDWVNAIFPDVSTETVVPWAGLRPMMPSMMPRVGRGKHQGVFYNTGHGHLGWTLSACTAEMISALVEANAHSNAP

SEQ ID NO: 693 - DNA, 396 bp, Unknown
  Obtained from environmental sample
atgaagacctttcttctccgatttttcacgtggtggaatggtgcgaccctcaacacgatgttccacacctggcgtcgtggagaacgtgtgggtgaagatgagtttggcaatgtttattatcagggcgggcaagactcggaaggccggacacgccgttgggtcattttcaacggtgaatcggaagcatctgccgttccacccggctggaatggctggctccattacacggtcgatgtcgcgccgagtgaagaagattataaaccacacgattggcagaaaaaccatcaagccaaccctaccgggacggccatggcatatcgtcctaaaggctcaattgcgtcgcaggaaaagcgtcctgtggtcactggcgattacgacgcttggtctccagaataa

SEQ ID NO: 694 - protein, 131 aa, Unknown
  Obtained from environmental sample
  DOMAIN (27)...(130): NADH ubiquinone oxidoreductase subunit NDUFA12
MKTFLLRFFTWWNGATLNTMFHTWRRGERVGEDEFGNVYYQGGQDSEGRTRRWVIFNGESEASAVPPGWNGWLHYTVDVAPSEEDYKPHDWQKNHQANPTGTAMAYRPKGSIASQEKRPVVTGDYDAWSPE

SEQ ID NO: 695 - DNA, 1164 bp, Unknown
  Obtained from environmental sample
atgcttttcggaaaatggagaagcagtcgagaggacacacatatgcaaacggactatctgatcataggcgcaggtatagccggagcgtccataggctactggctcgcgccacatgcgaaagttgttttgctggaacgggaaacacaaccgggttatcacagcaccggccgctccgctgcgcttttcatggaaagctacggcccgcctcaggtgcgcgcactcacctgcgcgagtcgcgcgtttttcgagaggccgcccgccggcttcaccgaccaccccatcctttcgcctcgaggtgcaatgatggtggccggcatcggccaggaagatttgcttgaggcccagtatgcgattgtgcagtccgtctcggatgacgcaaggctgctggatgtcgcaggcgcccaccagttggtgcctgtgttgcgccccgaccgggtactcggcgcggtatacgaaccggacgccgccgacatcgatgtgcattccctgcatcacggctacctgcgtggtgtcagggccgcgggcggtacgatttcctgtggcgccgaagtgactgccatggaatatcatcgtggtgtctggcgcgtgactgcaggcgaccacatttatgaagcgcctgtcgtcgtcaacgccgccggcgcatggtgcgacgttatcggatcgcttgccggcgcagcgccaaccggattggttccgatgcgccgctccgcttttacgttcgccccgcccgacggcgtcgatagctcccgctggccgatgttcatcgctgccgacgagtccttttacgtgaagccggatgccggattgctgctcggctcgcccgccaacgccgatccggtagcgccgcacgacgtccaggcggaagagctggatattgcgctggcaatcgatcgcatagaaaacatgacgaccatgacgatccgccgcccgaagaatgtctgggcgggactgcgttcgtttgtcggagacggtagcctggtcggcggttttgacgcgaacgtgccgggttttttctgggccgccggacaaggcggttacggcattcagtcctcggcggctgcaggtgaactctatgcaacactgctgaggggcctgcctgcgccgtcgcgaatcagcgacttcggcgtgcacatagaggcgctgagtcctgcgcgtatcaggtaa

SEQ ID NO: 696 - protein, 387 aa, Unknown
  Obtained from environmental sample
  DOMAIN (18)...(361): FAD dependent oxidoreductase
  SITE (305)...(308): N-glycosylation site. Prosite id = PS00001
MLFGKWRSSREDTHMQTDYLIIGAGIAGASIGYWLAPHAKVVLLERETQPGYHSTGRSAALFMESYGPPQVRALTCASRAFFERPPAGFTDHPILSPRGAMMVAGIGQEDLLEAQYAIVQSVSDDARLLDVAGAHQLVPVLRPDRVLGAVYEPDAADIDVHSLHHGYLRGVRAAGGTISCGAEVTAMEYHRGVWRVTAGDHIYEAPVVVNAAGAWCDVIGSLAGAAPTGLVPMRRSAFTFAPPDGVDSSRWPMFIAADESFYVKPDAGLLLGSPANADPVAPHDVQAEELDIALAIDRIENMTTMTIRRPKNVWAGLRSFVGDGSLVGGFDANVPGFFWAAGQGGYGIQSSAAAGELYATLLRGLPAPSRISDFGVHIEALSPARIR

SEQ ID NO: 697 - DNA, 1257 bp, Unknown
  Obtained from environmental sample
atgaaggtcgttgtgctcggggccggcgcgatcggcgtggcgacggcctattacctgcagcgtctcggccacgacgtcacggtgatcgagcggcagagtggagccgccctcgaaaccagcttcggcaacggcgccatcatccatgcgagcgaggcggggccctggtcgcagcccggcatgccgctcaagatcctgaaatggctggggcgcgaggatgcgcccgtcctgctccgcgcggcggcattgccgcagatgtggcgctgggggcttagcttcctcgccaactgcagcagcgatcgcttccgccagaatgcgcaggccaatctccgtctggtgctctacagcctgcgctcgctgcaggagatccgcgcggaaaccggcatcgactacgatcacgccaccaacggcgtgatgaagatctatcgcgacccgcaatctttcgcggcgggtcgcgcgaaggtggcggccctcgccgcgcacgggctggtggcggacgaactctcacccgccgactgcgcgcgggtggagccggcgctggccgacaccgccagctcgctcgttggcgggctgcatttcacccgcgatgaaaccggcgactgcaatctgttcatgcaaggcctcgcgtcccacctcgcgcagcgcggcgtgactttccactacgacacgcgcatcgaccgcctggtcgcgcaatccggccgcattaccgcggtcgagacctcacgcgggcccatcgatgccgacatcgtcgtcgcggcgttgggcagcttcacgccgcatctgctgcgcccgctgggactcaagctgcccatctatccggtgaaaggcgtctccgtcaccgtgccggccgcgggatggaacgccgcgccgcgcatggcgatcatcgacgatggccgcatgttcggcctgatccgcatcggcgatcgtttgcgtgtcgccggctcggcggagatcacggactacgacacgacgcccagcccagcgcgcatcaaggccgtgatcggcaaggcgttggagacgttcccgggcttcgcccgctgctacgcgcccgagaccgccaaggtctgggcaggattgcgccccgtcacgcccagcggtgttgcctatatgggccgcacgccgatctccaacctgatcgtcaatgcgggccacggccatctcggctggacgatgtcgtgcggggcggggcgcctcgtcgccgacatcgtcagcggccgcccgcccggcatcgacatggcggggttcccgacgctgcactga

SEQ ID NO: 698 - protein, 418 aa, Unknown
  Obtained from environmental sample
  DOMAIN (2)...(401): FAD dependent oxidoreductase
  SITE (96)...(99): N-glycosylation site. Prosite id = PS00001
MKVVVLGAGAIGVATAYYLQRLGHDVTVIERQSGAALETSFGNGAIIHASEAGPWSQPGMPLKILKWLGREDAPVLLRAAALPQMWRWGLSFLANCSSDRFRQNAQANLRLVLYSLRSLQEIRAETGIDYDHATNGVMKIYRDPQSFAAGRAKVAALAAHGLVADELSPADCARVEPALADTASSLVGGLHFTRDETGDCNLFMQGLASHLAQRGVTFHYDTRIDRLVAQSGRITAVETSRGPIDADIVVAALGSFTPHLLRPLGLKLPIYPVKGVSVTVPAAGWNAAPRMAIIDDGRMFGLIRIGDRLRVAGSAEITDYDTTPSPARIKAVIGKALETFPGFARCYAPETAKVWAGLRPVTPSGVAYMGRTPISNLIVNAGHGHLGWTMSCGAGRLVADIVSGRPPGIDMAGFPTLH

SEQ ID NO: 699 - DNA, 1245 bp, Unknown
  Obtained from environmental sample
atggcgcgcaccgacgccgttgtactgggcgccggcatcgtcggcacttcgatcgcactgcacctcgccaagcgcgggctttcggtcgcgctggtcgacaaggggccgccgggcgagggcacctcctacggcaatgccggcgtgatcgaggccaacacgctgctgccgcatccgtttccgacgtcgttcggcgccatcctgaacgtcgcgctcaagcgggcgaccgaggccaattatcacctctcgttcctgccgcacatcgccccctggctgcttgaatatcgtgccaactccaccatcgagcgccgcatccgctacgccaacctgatgcggccgctgttcgcgcacgcgctgcccgagcacgaagcgctgatgctggagtcgggcgcgacgagatatcttcgcaaggaaggctggctcaaggtctatcgcaacaaggcgacgttcgatggaaccgcacgcgagcgcgcgctcgctgccgaattcggcctgccgcacgaggcgctcgaccgcgacggcgcgctggcgctcgaaccggcgctggcgccgcaattcgtcaacggcatctactggaagagctccgccagcgtgaccaatccgctggcgctgacgcgcgcctacatcgcgcgtttcaccacgctcggcggcgtggtgctgaccggcgatgcgcgcacgctgcatcgcgccaacgaccgctggcgggtcgagaccgacgaaggcccggtcgattcccgcgaggcggtggtggcgctcgggccatgggcgaccgatctcctgaagccgatggatgtcgatctcccgctcgaggtgaagcgcggctatcacctgcatttccgcccgcgcggcaatgccggcctgacgcgtccggtggtcgatgccgatgtcggctactgcgtcgcgccgatggagcaggggctgcggctcaccaccggcgccgagttcgccgaccgcgacgcgccgcccacgccggtgcagttcggccggctgttgccgcaggcgcgcgcgctgtttccgctcggcgagcaggtcgaggcgcagccgtggatgggttgccgtccgtgctttgccgattcaatgccggtgatcggccgcgcgcccggaaagaccgacctgtggcttgcttatggccacgcccattggggcctgacgctcgggccggtgaccgggcggctgctcgccgagatgatgaccggcgcgacgccgttctgcgacccgacgccctacgccgcggaacggtttcagtga

SEQ ID NO: 700 - protein, 414 aa, Unknown
  Obtained from environmental sample
  DOMAIN (5)...(395): FAD dependent oxidoreductase
  SITE (98)...(101): N-glycosylation site. Prosite id = PS00001
MARTDAVVLGAGIVGTSIALHLAKRGLSVALVDKGPPGEGTSYGNAGVIEANTLLPHPFPTSFGAILNVALKRATEANYHLSFLPHIAPWLLEYRANSTIERRIRYANLMRPLFAHALPEHEALMLESGATRYLRKEGWLKVYRNKATFDGTARERALAAEFGLPHEALDRDGALALEPALAPQFVNGIYWKSSASVTNPLALTRAYIARFTTLGGVVLTGDARTLHRANDRWRVETDEGPVDSREAVVALGPWATDLLKPMDVDLPLEVKRGYHLHFRPRGNAGLTRPVVDADVGYCVAPMEQGLRLTTGAEFADRDAPPTPVQFGRLLPQARALFPLGEQVEAQPWMGCRPCFADSMPVIGRAPGKTDLWLAYGHAHWGLTLGPVTGRLLAEMMTGATPFCDPTPYAAERFQ

SEQ ID NO: 701 - DNA, 981 bp, Unknown
  Obtained from environmental sample
atgaatcgaagtgtcgcaatcatcggtgcgggcgtttccggactgacatgcggcgtggttttcgccgaggcagggtatagcacagcgatcttcgccgaagaaatcggccgccataccacgtccggcgcggctggggcgatatggttcccgtacgatgccgaaccggctgaaaaagtgattccgtgggcgctcgaaagctacgacaggcttgtcgatctcactcgcattcctgaaagcggtgtctcgatgatcgagacacgccaattttcccggagcacggaaattcaaattccagattgggcgactccgctgggcgcacagcggctttcttccgtagcaactggcctgtttccggctcgcagtcacgcacagcgcgatggctacaatttcaagagcggtttctcgctgcgcgtccctttgacggacacaacgatttatctcgactatctcgcagcgagatttcgcgatgctggcggagacatcaacaggaaaatccagtttggaaaactcgaagaggtggatacaagattcgatctcgtacttaattgcgcaggaatcggtgcgcgcgatctcgtatcggatgccgatctcgagccgcatcgcggccaggtcgcaatcgtgccgaaaatcgaggggctttcctgcgcgattgtgtgtgatgacgcaccgctcatgtacgcaatcccgcgcagaaacgattgcctctttggcggaacaaacgatgtcagagacgatctcgcgcctgatcccggaaccacaggacgaatcattggcgaatgcagccgtgtgttgaacatcgaaacaccgccggtaatcgccgagcgcgtcggtctgcgcccgtttagaagatcaggcgtgcgcgtggaactcgatcagttgcgcgacggtcgcactgtcattcacaactacggccacggcggctccgggttcacgctctcctggggttgcgcccgtgaagcccttgatttggctaaatcataa

SEQ ID NO: 702 - protein, 326 aa, Unknown
  Obtained from environmental sample
  SIGNAL (1)...(22)
  DOMAIN (4)...(323): FAD dependent oxidoreductase
  SITE (2)...(5): N-glycosylation site. Prosite id = PS00001
  SITE (303)...(321): D-amino acid oxidases signature. Prosite id = PS00677
MNRSVAIIGAGVSGLTCGVVFAEAGYSTAIFAEEIGRHTTSGAAGAIWFPYDAEPAEKVIPWALESYDRLVDLTRIPESGVSMIETRQFSRSTEIQIPDWATPLGAQRLSSVATGLFPARSHAQRDGYNFKSGFSLRVPLTDTTIYLDYLAARFRDAGGDINRKIQFGKLEEVDTRFDLVLNCAGIGARDLVSDADLEPHRGQVAIVPKIEGLSCAIVCDDAPLMYAIPRRNDCLFGGTNDVRDDLAPDPGTTGRIIGECSRVLNIETPPVIAERVGLRPFRRSGVRVELDQLRDGRTVIHNYGHGGSGFTLSWGCAREALDLAKS

SEQ ID NO: 703 - DNA, 1248 bp, Unknown
  Obtained from environmental sample
atggcccggaccgatgcgatcgtgctgggggccggcatcgtcggcatctcggcagcgctgcatctcgccaagcgcgggctcgcggtggcgctggtcgaccggcgcggaccggccgaggaaacgtcgtacggaaatgccggcgtgctggaaggcaatacgctgttcgcgcatgccttcccgaaaggcttcggtgcgctgcttcgtatcgcgctgaagcaggcgcccgaggcgaattatcatctctcggcgctagccggcctcgcgccgtggctgcttgcctatcgcgccaatacgcgcggccaacgcgcgctggagtttgccaaagcgatgcggccgctctttgctcgcgcggtcgctgagcacgagacgctgatgggcgaggcgaatgcgtctcgctatctgcgcaaggacggttggatcaaagtctatcgcagcggcgaatcctttcaggatacggagcgcgagcgcacttatgcgcgcgagcttggtctcgatcaccgcgtgatgacgccggaagaggtgcgaacgctggagccatcgctcgcgccggtgttccagcatgcggtgcattggccgagcgctgcgagcgtgtccaacccggccgcagtggcgcgcgcctatgccgaacgcttcaccaagcttggcgggatcatcctcaagggcgacgccaagacgctgcaccggtccggccagagctggcgagtcgacaccgaggaggggccgatcgacgccaaggatgccgtcgtggcgctcggcccgtgggcgcccgacctgcttgggccgctcggcatccgcctgccgctcgcgttcaagcggggctatcaccggcactaccggtccaatggcaatgccgggctgacgcggccgatcgtcgacgccgataacggctactgtctcgcgccgatggagcagggcatccggctcaccaccggcgcggagttcgcccatcgcgacgacccgccgacccccgttcagttcgaccggctgctgcctgcggcgcgggagctttacccgctgggcgagggcatcgaggcgcagccctggttgggctcgcggccgtgctttgccgactcgcgcccggtgatcgggcgcgctccgggccagccggggctctggctcgactacggccacgcgcattggggactgacgcttgggccagtgtcgggccatctcttggccgacatgatcacaggcgccacgccgttctgcaatccggcgccgttttccgccgagcggtttcaatcctga

SEQ ID NO: 704 - protein, 415 aa, Unknown
  Obtained from environmental sample
  DOMAIN (5)...(395): FAD dependent oxidoreductase
MARTDAIVLGAGIVGISAALHLAKRGLAVALVDRRGPAEETSYGNAGVLEGNTLFAHAFPKGFGALLRIALKQAPEANYHLSALAGLAPWLLAYRANTRGQRALEFAKAMRPLFARAVAEHETLMGEANASRYLRKDGWIKVYRSGESFQDTERERTYARELGLDHRVMTPEEVRTLEPSLAPVFQHAVHWPSAASVSNPAAVARAYAERFTKLGGIILKGDAKTLHRSGQSWRVDTEEGPIDAKDAVVALGPWAPDLLGPLGIRLPLAFKRGYHRHYRSNGNAGLTRPIVDADNGYCLAPMEQGIRLTTGAEFAHRDDPPTPVQFDRLLPAARELYPLGEGIEAQPWLGSRPCFADSRPVIGRAPGQPGLWLDYGHAHWGLTLGPVSGHLLADMITGATPFCNPAPFSAERFQS

SEQ ID NO: 705 - DNA, 1233 bp, Unknown
  Obtained from environmental sample
atgaagagcgcaatcgtcctcggagccggcatggtcggtgtgtccacggcgcttgcgctccgcgaccgcggctgggacatgacgctggtcgaccgcaaggcgccagggcaggagaccagcttcggcaatgccggcatcatccagggcgaggccgtcgagccctatgccatgccgcgttcgatcggcgatctcttcagcatcgcgctcggccgcagcaatgacgtgctctattccttccgcgagctgcccttccatgtctcatcgctgctgcgctactggtggcattcggcgccggtccggcatcgtaccgcgggtgctgcctgggcgtcgctcatcgttcgcgccaccggcacgcatgagccgctgatcgaacgcgccggcgccggcaacctcgtccggcgcggcgggtttcatctgatgtttcgtgggcacgacgccctggccgaggaggtcgccgacgccgaacgtaaggcggccgtctacggcacgaaattccgcacggtgacccctgccgagatgcggcaggccgagcctgctctgaagcagggtggagcaggcggtatccagtggctcgattcctggaccgtgagcgatcccggcggcctggtctgcgcctacgcggcgctgttcgagcgcagcggcggacgcttcgttcatggcgatgcgtcgaccctgcgccggtcgggttccggctgggcggtggacacggattccggcaccgtcgaggcggagacggcggtcgtcacgctcggcccgtggtcgacgaccatgctccggcgcttcggccaccgttttccgatggtccacaagcgcggctatcacgcccattaccgggcgccgcaatcgctcaatgcgccggtcatggacggcgacaacggctatctgctgctgccgatgctggccggtacgcgcatcacgacgggagcgcatatcgcgcggatcggcgtgccgccggcctatctccagctctcccgcgccgaggctgcggctgtcgatctcttcgaactcgggccgcggatcgaggacacgccctggcagggcacgcggccctgcatgccggatatgttgccggtcattggcccgtcacagcacgagaagggtctctggctgagtttcggtcacggtcatcagggatttacgctcgggccggcgagcgccgaggcgttggctgcgatgatgagcggcgagacgccgccggtcgacatggtgccgttccggccggatcggtactaa

SEQ ID NO: 706 - protein, 410 aa, Unknown
  Obtained from environmental sample
  SIGNAL (1)...(19)
  DOMAIN (3)...(392): FAD dependent oxidoreductase
MKSAIVLGAGMVGVSTALALRDRGWDMTLVDRKAPGQETSFGNAGIIQGEAVEPYAMPRSIGDLFSIALGRSNDVLYSFRELPFHVSSLLRYWWHSAPVRHRTAGAAWASLIVRATGTHEPLIERAGAGNLVRRGGFHLMFRGHDALAEEVADAERKAAVYGTKFRTVTPAEMRQAEPALKQGGAGGIQWLDSWTVSDPGGLVCAYAALFERSGGRFVHGDASTLRRSGSGWAVDTDSGTVEAETAVVTLGPWSTTMLRRFGHRFPMVHKRGYHAHYRAPQSLNAPVMDGDNGYLLLPMLAGTRITTGAHIARIGVPPAYLQLSRAEAAAVDLFELGPRIEDTPWQGTRPCMPDMLPVIGPSQHEKGLWLSFGHGHQGFTLGPASAEALAAMMSGETPPVDMVPFRPDRY

SEQ ID NO: 707 - DNA, 1275 bp, Unknown
  Obtained from environmental sample
atgagccagattttgcttttggggagcagcatggcacgtaccgatgcaatcgttctgggcgccggcattgtcggcacatcggtcgcgctgcaccttgccaaacgtggcctgtcggtcgcgctggtcgaccggcgtggtcccggcgaggagacgagctacggcaacaccggcgttattgtcggcgccagcgtgtttccgaccgcgtttccgcgcagcctgaagaagctcattcaggtcgcgctcaagcgcgcgcccgaggcgaactatcattggggcgacctgctcaagatcgcgccctggctgatttcctatttcaatttctcgacgccggagaagctgaaggacagtgccgtcaagctgcgcccgctgatgagccactcggtcgccgagcacaagctgctgctcgaagaggccggcgcgatgaaatatttgcgcgagaacggctggatgacgatttatcgcagcgatgcggccttcgaggggatgaagccgcagcttgaattcggcgcgcagatcggcgtcgcggcgcagccgctcgacatgaacgccgcgctcacgctcgagccgagcctcaatccggtgttccgccatgcgctgatgtggccggacgttgcgtcgctctccaacccgctgaaggtgacgcgcgcctacgcggcgcgcttccaggcgctcggcggcgtgctgctcaagggtgacgcgcgcaagctgcgccgcgccgacggacgctggcgcgtcgagaccgaggaggggccggtcgactcggcgaacgccgtcgtgacgctcgggccctggtcgccggacgtgctcagccccctcggcatcaaggtcccgctcggcatcaagcgcggctatcaccgccactttgagccgaagggaaatgcgtcgctcgcgcgcccggtgatcgacaccgaaatcggctatgcgatcaccccgatggagcagggcatccgcctgacgaccggcgccgaattcgccgatcgtgatgcaccgcccacgccggtgcaattcgaccgtctgctgccctacgccagagagctgtttccgctcggcgagccgaatgagccggagccgtggctcggccgtcgcccgaacatgccggactcgctgccggtattgggccgcgcgcccgggcaggatgggctctggctcgccttcggccacgggcattgggggctgaccatggcggccgtgaccgggcggctgatcgccgagctgatgaccggcgcgacgccgtttgtcgatccggtgccttaccgcgcggatcggttcaggtag

SEQ ID NO: 708 - protein, 424 aa, Unknown
  Obtained from environmental sample
  DOMAIN (15)...(405): FAD dependent oxidoreductase
  SITE (107)...(110): N-glycosylation site. Prosite id = PS00001
  SITE (297)...(300): N-glycosylation site. Prosite id = PS00001
MSQILLLGSSMARTDAIVLGAGIVGTSVALHLAKRGLSVALVDRRGPGEETSYGNTGVIVGASVFPTAFPRSLKKLIQVALKRAPEANYHWGDLLKIAPWLISYFNFSTPEKLKDSAVKLRPLMSHSVAEHKLLLEEAGAMKYLRENGWMTIYRSDAAFEGMKPQLEFGAQIGVAAQPLDMNAALTLEPSLNPVFRHALMWPDVASLSNPLKVTRAYAARFQALGGVLLKGDARKLRRADGRWRVETEEGPVDSANAVVTLGPWSPDVLSPLGIKVPLGIKRGYHRHFEPKGNASLARPVIDTEIGYAITPMEQGIRLTTGAEFADRDAPPTPVQFDRLLPYARELFPLGEPNEPEPWLGRRPNMPDSLPVLGRAPGQDGLWLAFGHGHWGLTMAAVTGRLIAELMTGATPFVDPVPYRADRFR

SEQ ID NO: 709 - DNA, 1233 bp, Unknown
  Obtained from environmental sample
atgaaattcgattcggtcgtgcttggcggcggcatcgtcggcgtttccgtggctttgcagttgcagcggcgcggcctttcggtcgcgctcgtggaccgcagggcgccgggcaatgaaacatcgcacggcaacgggggattgatccagcgcgagggcgtctacccctacgcgtttccgcgcgagctttccacgctgttgcgctacgcgcgcaaccgctcgacagacgtgcgctatcacccgggcgcgatgcccaagctgctgccttttctctatcgctattggcaccattcgcgcgccgaccggcacgcgctgatagcgcgcgcgtattccacgctcatcgagcactgcgtgagcgagcatcgcgcgctgatcgaggcggcgggcgcccaggcgctgttgcgcaccaacggctggatgaaggtgtttcgcagcgcggtcgccatggacgctacgctcgccgaggcgcagcgctggcagcgcgagtacggtgtaggccacgaagcgctggacgccgcggcgttgcgcgccgccgagcccgcgttgagccacacgctggtgggcggcgtgcgctacaccgattccgattcggttagcgatccgaagggattggtcacggcgtactcgaagctcttcgagcagctaggcggccgtgtgctgattggcgacgccgcgacgctcgaaccgtcgtggcgcgtcatgacgcaggatggtcccgtgctggcgaagtctgcggtcatcgccatggggccgtggtcgggcgatctcacggcgcggctgggctacgagttgccgctcgccgtgaagcgcggctatcacatgcactacgcggtcacgaatggcgcgaagctgaatcagccggtgctcgacgccgaagcgggcttcctgattacgccgatgctgcgcggcacgcgcctcacgacgggcgtcgaactcggctttcgcgattcgcccaagacgcccgttcagctcgaagcggtcgagccgctcgcgcgcgatattttccctctgggcgcacggctcgacgccgaaccgtggctgggccgccgtccctgcacacccgacatgatgccgatcatcggccccgcgcccaagcacgacgacctctggttcgcgttcggccacgcgcatcacggtcttacgcttggcccggtcacgggccgcctgatcgcggagatgatgacgggcgcgccgaccgtggtggacccgcggccattccgtgtcgatcggttttaa

SEQ ID NO: 710 - protein, 410 aa, Unknown
  Obtained from environmental sample
  DOMAIN (4)...(392): FAD dependent oxidoreductase
  SITE (38)...(41): N-glycosylation site. Prosite id = PS00001
  SITE (72)...(75): N-glycosylation site. Prosite id = PS00001
MKFDSVVLGGGIVGVSVALQLQRRGLSVALVDRRAPGNETSHGNGGLIQREGVYPYAFPRELSTLLRYARNRSTDVRYHPGAMPKLLPFLYRYWHHSRADRHALIARAYSTLIEHCVSEHRALIEAAGAQALLRTNGWMKVFRSAVAMDATLAEAQRWQREYGVGHEALDAAALRAAEPALSHTLVGGVRYTDSDSVSDPKGLVTAYSKLFEQLGGRVLIGDAATLEPSWRVMTQDGPVLAKSAVIAMGPWSGDLTARLGYELPLAVKRGYHMHYAVTNGAKLNQPVLDAEAGFLITPMLRGTRLTTGVELGFRDSPKTPVQLEAVEPLARDIFPLGARLDAEPWLGRRPCTPDMMPIIGPAPKHDDLWFAFGHAHHGLTLGPVTGRLIAEMMTGAPTVVDPRPFRVDRF

SEQ ID NO: 711 - DNA, 1266 bp, Unknown
  Obtained from environmental sample
atgaaggcagtcatcatcggcagcggcctgatcggcaccacatcggcctacttcctcgcgcgccgcggctgggaggtcaccgtcctcgatcgtcaggacggccccgggcaggagacgagcttcgccaacggctcgctcctgacgcccagcatgccggagccgtggaacgcgcccgggagctggcgggtgctgctcaagtccctcggccgctccgactcgccgctgcagctgcgcctcaaggcgctgccgcacctcgcgggctggggcaccgggtttctgcgcaactcgagcccggcgcgctacgcgcgcaacacggtgagaaatctgaagctcgcgctgcattccatcgaggtgatgggccgcctgcgccaggagatcgggatcgagtatggaggcgccgcgccagggacattacgagtcattcgcgatccggcggcgttcgagcgagcgcttgcgtgggcggagcagctccgggcggacggactcacataccggcgcctgagcaccgatgagatcgtggcgctggagccggcgctcgctcccgttgccgggcggctggccggcggcattcattacccggtcgatgagatcggcaacgcctacaagttttgcgtcggtctcgcggatcacgcccgccgcgccggcgtggatttccgctttcaaacgcccgtgactcgaatcgaggtccgtcaggggaaggtggcggcggtgctgagcggcgacaagcgcttcagcgccgaccgttatgtcgtggcggccggcagctacagtccgcttctcttcaaggcgctggggctccgggtgcccgtgcggccggccaaaggctactcgctgactttcgagcgtcctgccctcgacccgccgtttcgtatgcctgtggccgacgatgacttccatgccgtggtggtgccgctcgagaatgtcatccgcgtggcgggaaccgcggagttcaccgggtatgacctgtcattgccggacgcacgtattcagaatatcctgactctcgtcagggaggtgctgcccaagggcggattcgagcgcgcgggggcgaaggcgtggtgcggccttcgcccgatgtcggtcgacggcgtgccgatcatcggtccgacgccgatcgccaatctctggaccaacacgggacacggacatctcgggtggaccatggccgctgcttccggccaactcctgtcggatctcctgacgggggcatcgccggccgtcaaccccgacgcctacgctctcgcccggttcgccacagggggatag

SEQ ID NO: 712 - protein, 421 aa, Unknown
  Obtained from environmental sample
  DOMAIN (2)...(399): FAD dependent oxidoreductase
  SITE (43)...(46): N-glycosylation site. Prosite id = PS00001
MKAVIIGSGLIGTTSAYFLARRGWEVTVLDRQDGPGQETSFANGSLLTPSMPEPWNAPGSWRVLLKSLGRSDSPLQLRLKALPHLAGWGTGFLRNSSPARYARNTVRNLKLALHSIEVMGRLRQEIGIEYGGAAPGTLRVIRDPAAFERALAWAEQLRADGLTYRRLSTDEIVALEPALAPVAGRLAGGIHYPVDEIGNAYKFCVGLADHARRAGVDFRFQTPVTRIEVRQGKVAAVLSGDKRFSADRYVVAAGSYSPLLFKALGLRVPVRPAKGYSLTFERPALDPPFRMPVADDDFHAVVVPLENVIRVAGTAEFTGYDLSLPDARIQNILTLVREVLPKGGFERAGAKAWCGLRPMSVDGVPIIGPTPIANLWTNTGHGHLGWTMAAASGQLLSDLLTGASPAVNPDAYALARFATGG

SEQ ID NO: 713 - DNA, 1233 bp, Unknown; identical to SEQ ID NO: 709
  Obtained from environmental sample

SEQ ID NO: 714 - protein, 410 aa, Unknown; identical to SEQ ID NO: 710
  Obtained from environmental sample
  DOMAIN (4)...(392): FAD dependent oxidoreductase
  SITE (38)...(41): N-glycosylation site. Prosite id = PS00001
  SITE (72)...(75): N-glycosylation site. Prosite id = PS00001

SEQ ID NO: 715 - DNA, 1251 bp, Unknown
  Obtained from environmental sample
atgaaagtcattgtcatcggcgccggcgtcgtcggtgccaccacggcactgagcctggtcgagcgtggtctcgaggtcacgctgcttgatcggcatccggttccggcggccgagaccagtcacgccaacggaggcggagtcacaccggggcacgccgaaccgtggaattctcccggcatcctgggacgcctgctcaggggctccggcgaccgggcgccctaccggattcacgcccgcgccctgcccggaatgatgggctggggctcgagctttctgtggcagtcgaggtcctcgcgctacttcgtcaacgcgcgcaataacacgcgcctggcggtctactccgggcagtgcctgaagcgtctgcgcgagcgccacgcgatcagctaccaccagtacaccgatggctcgctggagctgtacttcaaccgcgctgaactggaccatgcggtcaaacttcgtcgcggcatcggcgatcctggcgttgaactcagggagatctcgcccgaccaggtagtggctatggagccggcactggctccggtggcccggcgcatggtcggtgccctgtttctgccgctgcatgaatccggcgatgcctgtgaatttgccgccgaagtggctcgttgcgcgcagggactgggggcgagtatcaggctgggccagaccgtcgaagcccttgtccaccgtagcgggagaattaccggggttcagctggtctcggggttcctggccgcggatgcagtggtgctcgcggccggcgtgtccagtcgggcactggcctggcccttgggtctgaaactgccgatcctgccagtcaagggctactcggccaccctggttctggaccagcctgagttggccccagccattccattgctggatctcgaacaccgcatcgtcaccgcccgctacggtcagcgcctgcgcatcgccggcctggcggatttcgaaggctatgattccaatatcaggcccgggcgggtccagatgctgctggattcagccactgtgctgctgccgcgcctggccgatgagttacacgctggcaaggcccagacctggtgtggtttcagaccaatgacacccaagggcccgccgctgctgggcccgacccgggttccggggttgtttctgaacactggccacggctcgatgggctggactcaggccgccggttcagccgagatcctggctgatcttgtcaccgggcgcgaagcggcgatcgatctgagcggcttgacgctcgggtga

SEQ ID NO: 716 - protein, 416 aa, Unknown
  Obtained from environmental sample
  DOMAIN (2)...(400): FAD dependent oxidoreductase
  SITE (107)...(110): N-glycosylation site. Prosite id = PS00001
MKVIVIGAGVVGATTALSLVERGLEVTLLDRHPVPAAETSHANGGGVTPGHAEPWNSPGILGRLLRGSGDRAPYRIHARALPGMMGWGSSFLWQSRSSRYFVNARNNTRLAVYSGQCLKRLRERHAISYHQYTDGSLELYFNRAELDHAVKLRRGIGDPGVELREISPDQVVAMEPALAPVARRMVGALFLPLHESGDACEFAAEVARCAQGLGASIRLGQTVEALVHRSGRITGVQLVSGFLAADAVVLAAGVSSRALAWPLGLKLPILPVKGYSATLVLDQPELAPAIPLLDLEHRIVTARYGQRLRIAGLADFEGYDSNIRPGRVQMLLDSATVLLPRLADELHAGKAQTWCGFRPMTPKGPPLLGPTRVPGLFLNTGHGSMGWTQAAGSAEILADLVTGREAAIDLSGLTLG

SEQ ID NO: 717 - DNA, 912 bp, Unknown
  Obtained from environmental sample
aaagaattggccaccacctggttggcagacgagttgttgccttttgcttatgaggcttataccgctatgggcgaactgatagggcagccagtaatatcggaaacccccattttggcatttccagccaatgcggaaatgctgcaggtatataacaaaaggataaaggagggttcgccctggatacatgcagtggagtcgccacaggcctgggaaggtattttcaactttttgcatcaggtggtatgcttgcgccccgtttacagggttcaaataggtgccatgctacaaggctgggccagcctgctggaaaagtcggatgatatttggctgcatcattttgacgatcaactacttacagtacatgacgacgggattacttatcagggcgttcatgcgaaagccttgttgttttgcgacgggtatcatgcggagaaaagcagattctggcaggggttgccttttagtgtaaataagggcgaagcattgatcgttgatattcccgcactacccggggagtatatctacaagtttgggataaccacattggcgccatggagcgatggcctgtggtgggttggtagcagttacgacaaccggtttacccatccacatcccacagaggcatttcgcaggcaaatggaattttttctggcccaaaccctgcgtgtaccttttcgtatcacagggcatatttgtggtttgcgaccggctaccatcgaaagaaggccatttgcaggcctgcatgcccggtataagcagataggtattctgaatggcctgggtaccaagggagtttcactggcgccctggtttgcccggcaactcgctctgcatttgatacaaggtgagcctatagaccccgccgccaatgtgcagcgtttcaaaagagcattcgaaaaatcaatgaattaa

SEQ ID NO: 718 - protein, 303 aa, Unknown
  Obtained from environmental sample
KELATTWLADELLPFAYEAYTAMGELIGQPVISETPILAFPANAEMLQVYNKRIKEGSPWIHAVESPQAWEGIFNFLHQVVCLRPVYRVQIGAMLQGWASLLEKSDDIWLHHFDDQLLTVHDDGITYQGVHAKALLFCDGYHAEKSRFWQGLPFSVNKGEALIVDIPALPGEYIYKFGITTLAPWSDGLWWVGSSYDNRFTHPHPTEAFRRQMEFFLAQTLRVPFRITGHICGLRPATIERRPFAGLHARYKQIGILNGLGTKGVSLAPWFARQLALHLIQGEPIDPAANVQRFKRAFEKSMN

SEQ ID NO: 719 - DNA, 1251 bp, Unknown
  Obtained from environmental sample
atggctgggaccgatgtgatcgtgctgggcgccggcatggtcggcgtatcgacggcgctgcatctgcaaaagcgcggccagagcgtggtgctggtcgaccgccgcggcgccggcgaggagacgagctacggcaataccggcatcatccaacgcgagggcgtcgtgccctacccgtttccgcgcgacgtttccctgctgctgcgctacgccctcaatcgcctgcccgagtcgcacctcgattggcgggcgctgcccgccatcgcgccttggctctttcgctactggcgggcctccacgcccgcagccatcgcctcgacctcgcgcggggcacggccgctgatcgaacgttgcgtgatcgaacacgaggctttgatgggcgaagccggcgcgctcggtctcatgcgccgcaccggctatctgcgcctctatcgctcgctgtcggcgctagacagcgccatggcgaaggacaaggccgccagcgaaacctatggcgtcaatttcgagatgctgggggccggcgcgctctcctcgctggagccgcacctgaaggccacgctggcgggcgccatgttcatgcccgatccggtcagcgtctcggaccccgaggccgtcaccaaggcttacgcccgcctgtttcaggagcgcggtggccgctttgcccgcggcgaggccggcactctcaaagccgcgtccgggggatgggaggtgcagacggccggcggcagcatcagcgctcccgccgtggtgatcgcgctcgggccctggtccaacaccttgttccgccggctcggctaccgcatcccgtttggcgtcaagcgcggctatcacatgcattaccgtgccgaaggcaatgccaccctcaaccggccggtgatcgatgccgagtacggctatgccttaacgccgatggcgcgcggcatccggcttaccacgggtgccgagtttgccttgcgcgatgcgccgccgacgcccgtgcagctcgcccgcgtcgagcccttggcgcgccagattttcccgctcggcgagcggctcgacgccgagccatggctcggccggcgtccgtgtctgcccgacatgctgccggcggtgggccgcggcgcacatcacagcggactgtggttcaatttcggccatcatcacttgggctttaccctggggccggtgaccgggcgtctgctggcggagatgatgaccggcgagacgccgttcaccgatccgacgccctacggccccgagcgcttcggctcatga

SEQ ID NO: 720 - protein, 416 aa, Unknown
  Obtained from environmental sample
  DOMAIN (5)...(396): FAD dependent oxidoreductase
  SITE (288)...(291): N-glycosylation site. Prosite id = PS00001
MAGTDVIVLGAGMVGVSTALHLQKRGQSVVLVDRRGAGEETSYGNTGIIQREGVVPYPFPRDVSLLLRYALNRLPESHLDWRALPAIAPWLFRYWRASTPAAIASTSRGARPLIERCVIEHEALMGEAGALGLMRRTGYLRLYRSLSALDSAMAKDKAASETYGVNFEMLGAGALSSLEPHLKATLAGAMFMPDPVSVSDPEAVTKAYARLFQERGGRFARGEAGTLKAASGGWEVQTAGGSISAPAVVIALGPWSNTLFRRLGYRIPFGVKRGYHMHYRAEGNATLNRPVIDAEYGYALTPMARGIRLTTGAEFALRDAPPTPVQLARVEPLARQIFPLGERLDAEPWLGRRPCLPDMLPAVGRGAHHSGLWFNFGHHHLGFTLGPVTGRLLAEMMTGETPFTDPTPYGPERFGS

SEQ ID NO: 721 - DNA, 918 bp, Unknown
  Obtained from environmental sample
atgcacgaggtgacggtggtcggcgcgggcgtggtagggctgaccaccgcggtccgtctccaggaagcgggacaccgggtccgtgtcgtctcggccgagcgccccgagcgaaccacgtccgccgccgccggcgccgtctggtaccccttctcggtcggccccccggaggcggtgagtcgctgggcccgggcgacgcgggcctggctgctcgagctgtcccgcaccgtgccccaggccggcgtggacatgctcaccgtccgcgagtgcgctgccgacgagcagcgcccctggtgggcagacgcggtcgagccggtccggctggtccacggcgcacagccgagcggggcgcacctcgcctgggagttcgaggcgccgcgggtcgagcccgcgctccatcttcgctggctggagtcgcggctcgaccggccgatcgagatcgcccccgtcgatcggctggacgacgtccccggtgacacggtggtgaactgcacggggatcggggcccggcggctcaccggcgaccagacgctgcaggcgctgctcgggcagacggcgatcgtcgagccgggtgaggtcgacccccggaagatgtacggcgacgagcgcgacctctcgaggatgctctacgtcatcccgcggcgaggcgaggtggtcgtcggcggatgcgcccttcccttcgacggcgacgtgccgcctccgcccgatgctgcgctccggactgcaatcctggagcgggcgcgcgcggcgggattccgccacggtccggtgctccgggacgcggtggggctgcgtccggtccgtcccgaggtgcgggtcgagcgcgtgggacgcatcgtccatcactacggtcacggcggcgccgggtacacgctcgccaggggctcgtccggagacgtcgcgtcgctcgtcgcacggtga

SEQ ID NO: 722 - protein, 305 aa, Unknown
  Obtained from environmental sample
  DOMAIN (3)...(302): FAD dependent oxidoreductase
  SITE (164)...(167): N-glycosylation site. Prosite id = PS00001
MHEVTVVGAGVVGLTTAVRLQEAGHRVRVVSAERPERTTSAAAGAVWYPFSVGPPEAVSRWARATRAWLLELSRTVPQAGVDMLTVRECAADEQRPWWADAVEPVRLVHGAQPSGAHLAWEFEAPRVEPALHLRWLESRLDRPIEIAPVDRLDDVPGDTVVNCTGIGARRLTGDQTLQALLGQTAIVEPGEVDPRKMYGDERDLSRMLYVIPRRGEVVVGGCALPFDGDVPPPPDAALRTAILERARAAGFRHGPVLRDAVGLRPVRPEVRVERVGRIVHHYGHGGAGYTLARGSSGDVASLVAR

SEQ ID NO: 723 - DNA, 1251 bp, Unknown
  Obtained from environmental sample
atgcacaccattgtcatcggcgccggcgtcgtcggcgccagcacggcgctgagcctggccgaacgcggcattcaggtcaccgtcctggatcgtcacgccgaggctgccgctgaaaccagccatgccaacggtggcggtatcactccgggccatgccgagccctggaacgccccaggcatcgtcaaacgtttgctgacccgttctggtgccggcgagccgtttcgtatccatgcccatgccctgccagggctgatcggatggggactcagctttctgtggcagtcaaaggcatcgcgctactacctcaatgccaggaacaacacgcggctggcggtgtattccggccaatgcctgaagcgcctgcgcgagcgccatgcgctcagctatcaccagtacaccgacggctctctggagctctacttcagccaatccgaactggaccatgcgctcgacctgcgccgcaagatcggcgatcctggcgtcgagatccgggttatcagcgtcgacgaagtgcttgccatggagccggcgctcgaaccggttgccgggcggatggtcggtgccatgctgctgccgctgcacgaatccggcgatgcctgcgttttttcagccgagatgctgcgctgtgccaagcagctgggggccaaaatccggctgggtaccaatgtcgatcgcatcgaacagcgccagggccgggtggtcggtgttcgccttcatgaccagcaattgctggaagccgatgcggtcgtcgttgccgccggctgcagctcgcctgcgctggtcaaaccgctgggcttgcgtctgccgatctatccggtcaagggctattcggccacgctggcgctcgaacagaccgatctggcaccgaccgttccgctactggacctggaacatcgcatcgttaccgcccgcttcggcaagcgtctgcgcatggccggcctggccgactttgacggccacaatcgcgatatccgatccgaccggcttaacctgctgctggaatctgcctgtgccctgctgccgcgcctggccgacgaaatccggtccggccgcgccgaagcctggaccggcctgcgcccgatgacgcccaagggtccgcccttgatcggccctacacgcattcccggtttgttcctgaacaccggccacggcgccatgggctggacccaggccgccggctcggccgaggtgctggccgatctgctgatcggacggaccccaggggtcgagcttgccccttatatcccctga

SEQ ID NO: 724 - protein, 416 aa, Unknown
  Obtained from environmental sample
  SIGNAL (1)...(20)
  DOMAIN (2)...(401): FAD dependent oxidoreductase
  SITE (107)...(110): N-glycosylation site. Prosite id = PS00001
MHTIVIGAGVVGASTALSLAERGIQVTVLDRHAEAAAETSHANGGGITPGHAEPWNAPGIVKRLLTRSGAGEPFRIHAHALPGLIGWGLSFLWQSKASRYYLNARNNTRLAVYSGQCLKRLRERHALSYHQYTDGSLELYFSQSELDHALDLRRKIGDPGVEIRVISVDEVLAMEPALEPVAGRMVGAMLLPLHESGDACVFSAEMLRCAKQLGAKIRLGTNVDRIEQRQGRVVGVRLHDQQLLEADAVVVAAGCSSPALVKPLGLRLPIYPVKGYSATLALEQTDLAPTVPLLDLEHRIVTARFGKRLRMAGLADFDGHNRDIRSDRLNLLLESACALLPRLADEIRSGRAEAWTGLRPMTPKGPPLIGPTRIPGLFLNTGHGAMGWTQAAGSAEVLADLLIGRTPGVELAPYIP

SEQ ID NO: 725 - DNA, 1260 bp, Unknown
  Obtained from environmental sample
gtgaaggtcgtggtgctcggagcgggcgtgatcggcgtgaccagcgcctggtacctgtcggaggcaggacatgaggtgacggtcgtcgatcggcagccgttcgccggcctcgaaaccagcttcgcgaacggcggccagatctcggtcagccacgccgaaccctgggccaacccgggcgcgccgctcaacatcctgcgctggctcggccgggaagatgccccgctgctgttccgcccgcgcgtgagcccgcgccaatggagctgggggctgcgcttcctgtacgaatgcctgccgggacgcacacgccgcaacacgctcgagatcctcaagctcgcgctgtacagccatcgggagctgaaggcgctgcgcgcgaagaccggcattcgctacgatcattccgagcgcggcatcctgcatctgcactcggacccgcgggcgctcgacgcagcgcgccaccgcgtcgagctgatgcgcgatcacggcttcgacatgcagctcaagaccgcgcagcagtgtctcgagatcgagcccgcgttgaaatacacgctcgcgagcctcgccggcggcacctacgcgccgagcgacgagtccggcgatgcacatcagttctcgcgtcaggtcgaagagctgtgccggcgggccggcgtcgcgttcgcattccagtcgaccgcgcagcgcctgctgctcgaaggcgggcgcatcaccggcatacgcatacggcatgtcgagggccccgagcagaccctgcgcgcggacgcgtacctgatgtgcatgggcagcttcacgccgttcctggtcgagcccgcgggcgtccggctgccggtctatccggtcaagggttactcggtgacgataccggtgccgcccgaagcggacggtgcgccgctcgtctgcctctccgacgaagccggtaagctcgcgatatcgcgtctcggcaatcggctgcgcgtcgccggaaccgccgagctcaacgactacgacagctcgatcaatccgtaccgctgcgcggcgatcctggcacgcgccgaagagctgtttcctcgcggcggcgccttcgatcgtgcgcagccgtgggccggcctgcgtccggccacgccgagcaacgtccccgtgatcgggcgcacgcgactctccaacctgtacctgaacaccggccacggcacgctcggctggacgctagcgtgcggctcgggccgcgcgatcgccgacatcatcagcggccgcaggcccgacgtcgattttgccttccgcggcggctga

SEQ ID NO: 726 - protein, 419 aa, Unknown
  Obtained from environmental sample
  DOMAIN (2)...(404): FAD dependent oxidoreductase
MKVVVLGAGVIGVTSAWYLSEAGHEVTVVDRQPFAGLETSFANGGQISVSHAEPWANPGAPLNILRWLGREDAPLLFRPRVSPRQWSWGLRFLYECLPGRTRRNTLEILKLALYSHRELKALRAKTGIRYDHSERGILHLHSDPRALDAARHRVELMRDHGFDMQLKTAQQCLEIEPALKYTLASLAGGTYAPSDESGDAHQFSRQVEELCRRAGVAFAFQSTAQRLLLEGGRITGIRIRHVEGPEQTLRADAYLMCMGSFTPFLVEPAGVRLPVYPVKGYSVTIPVPPEADGAPLVCLSDEAGKLAISRLGNRLRVAGTAELNDYDSSINPYRCAAILARAEELFPRGGAFDRAQPWAGLRPATPSNVPVIGRTRLSNLYLNTGHGTLGWTLACGSGRAIADIISGRRPDVDFAFRGG

SEQ ID NO: 727 - DNA, 1329 bp, Unknown
  Obtained from environmental sample
atgcatatcgtcgtgatcggcgcaggggtgatgggtgtgaccacggcttatgccttgagtcagcgtggtcacagggttacggttatcgagcagttatccagtgccgggcaggagaccagccgggccaatgccgggcagcgcagctatggctatgtctatccctggtcctctccggcgatgatcaaaaaggcgctgccctggctgttgcagaaggatggcccattgaagatgcagatgccgccgagccttgacgcgctgcgctttctgtttgccacctggcgttatgcaaaaccgggtatcttcgaggccaacaagcgcgccatgttgcaactggccgcctacagtcgtgagtgcttccataccctggaggccgaactctcgctggcgtttgatggtgaacagggtggggtgatggagctggccagtgatgcggccagtgcagcgagtctgcagtcagccttgccgttgctgcgcgaagtcggcgtgccacatcgcttcctgagcgcggaggaaaccctggcgcaggaaccggccttggcagggcatggccctttgctgggtgcgctgtggttgccggaggatggcaccggcgactgctgccacttcagtcaggcgctggcggctgcctgtgagtctcggggtgttgagtttcgctacaacacgcgagtggtttctgcagagctggagcgtgagcaggtggtcggattgatgctcaggccttctgatgaggatcaggtatattcagggccaaagtcaaaacaagagtcagaacccggctctgaacaggcgccagaactgttgcaggcggatgcctatgtgctctgtgctggaaccgagtccaaccgtctggggcaactgttaggcagtcggctgatgatctacccggtcaagggctactcactgaccgccccgctgctcgaccctgataaagcgccgcgctactcggtgatcgatgatcgcttcaaggtggtcacgacacggctgggttcgcggatgcgcgcgaccggctttgtcgagctgaccggtatgaatcgcgagatacccgaggcgcgtctggatacgattcgccgtgccgtggcgtcgcgttttccgggggcagcggatatgagtcaggctgagccctgggcaggatttcgacccatgacgccggatggcccgccgctgatcggtcgtggccagtatcacaacctctatctgaacaccgggcatggcacctttggctggaccctgtcggcggccagtgcacaggtgattgcacaactggtggatggggaggcgccggcagtagcgctggacgctttccgaccggaccggttcgaactggcctga

SEQ ID NO: 728 - protein, 442 aa, Unknown
  Obtained from environmental sample
  SIGNAL (1)...(18)
  DOMAIN (2)...(421): FAD dependent oxidoreductase
MHIVVIGAGVMGVTTAYALSQRGHRVTVIEQLSSAGQETSRANAGQRSYGYVYPWSSPAMIKKALPWLLQKDGPLKMQMPPSLDALRFLFATWRYAKPGIFEANKRAMLQLAAYSRECFHTLEAELSLAFDGEQGGVMELASDAASAASLQSALPLLREVGVPHRFLSAEETLAQEPALAGHGPLLGALWLPEDGTGDCCHFSQALAAACESRGVEFRYNTRVVSAELEREQVVGLMLRPSDEDQVYSGPKSKQESEPGSEQAPELLQADAYVLCAGTESNRLGQLLGSRLMIYPVKGYSLTAPLLDPDKAPRYSVIDDRFKVVTTRLGSRMRATGFVELTGMNREIPEARLDTIRRAVASRFPGAADMSQAEPWAGFRPMTPDGPPLIGRGQYHNLYLNTGHGTFGWTLSAASAQVIAQLVDGEAPAVALDAFRPDRFELA

SEQ ID NO: 729 - DNA, 1098 bp, Unknown
  Obtained from environmental sample
ttcggcacgagtgccggcgtgaagttctgcgccgcctatccgattaccccttcgaccgagattcaggaatggctggccgcgcatctgcccgaggtcggcggggttctggtccaggccgaggacgaactggcatcgatcaacatgtgccttggcgcctcgtttggcggtacgccggccatcaccgccacatccgggccgggtttctcgctgatggtcgaggcgctgggcctggccaccgccaccgaaacaccactggtggtgatcaacgtgatgcggggcggcccgtcgaccggcattccgaccaagtccgagcaggctgacctcgacgttgccgtgcacggcgcacacggcgacgcaccacggctggtatttggcgccaacagcatcggcgactgcatgagcaccacccaatgggcggtgcatctggccgaacatctgcaggtgcccgcggtggtcttgagcgaccagctcctgggccaggcgcgcgccgcgatcccgccgccacggccgcgcgactggcatgcccggcgcgacctgcccgtcttgcccgcggacgactacgagcgttttgccgataccggcagcggcatctcgccgatgagcctgcccggcatgcccggcggacagtacaccgccaccggactcactcaccggaccaacgcccggccttcggccatgaccaacgaccatcagctccagctcgacaagcgccggcgcaagcttgccagccatgactttggcgagtactgggccgacatcgagggagaaggcgagatcggtgtgctgacctggggctcatcgacattgcctgcgcgcgaagcgctcagtcgctgccgtgaagagggcatcgccgcgcgcctggtttcagtgcgcctgctcagtccgcttccgatcgaaccgctgctggccgcgctggccggctgcaagcggctactggtggtggagcagagtcattcggcccagtttcaccgctatctcaggtcgatgatcgacctgccggcacacacaagggcattccatcggcccgggccgttgatgctcactcccggcgagatcgccggacagatccgcgccatcgccctggagcaagccgcatga

SEQ ID NO: 730 - protein, 365 aa, Unknown
  Obtained from environmental sample
  DOMAIN (5)...(236): Pyruvate flavodoxin/ferredoxin oxidoreductase, thiamine diP-binding domain
FGTSAGVKFCAAYPITPSTEIQEWLAAHLPEVGGVLVQAEDELASINMCLGASFGGTPAITATSGPGFSLMVEALGLATATETPLVVINVMRGGPSTGIPTKSEQADLDVAVHGAHGDAPRLVFGANSIGDCMSTTQWAVHLAEHLQVPAVVLSDQLLGQARAAIPPPRPRDWHARRDLPVLPADDYERFADTGSGISPMSLPGMPGGQYTATGLTHRTNARPSAMTNDHQLQLDKRRRKLASHDFGEYWADIEGEGEIGVLTWGSSTLPAREALSRCREEGIAARLVSVRLLSPLPIEPLLAALAGCKRLLVVEQSHSAQFHRYLRSMIDLPAHTRAFHRPGPLMLTPGEIAGQIRAIALEQAA

SEQ ID NO: 731 - DNA, 1260 bp, Unknown
  Obtained from environmental sample
atgcatgtaatcgtcatcggcgcaggcgtggttggcgccgccacgaccctggccctggtcgagcgcggtgtgcgcgtgaccctgatcgaccgccgccctgaggctgccgccgaaaccagccacgccaatggcggcggcatcacgccgttgcattccgaaccatggaacgcgcccggacttttgggcaagctggtgcacaatgtcgggcgtcccgattcgccctacaagctctatccgctggccgtaccgggcatgggcctgtggggagcgaagtttctggtgcacatgcgcaagacccgattcgtcgccaatgcccggcgcaacttcaggctgggcctgtattcactcgactgcctgcggcgctgggtccagacctacgacattgatttccaccgcgccagcaacggatcgttgcaggtctatttcgaccccgagctgctcgaccaggccatgcgcctgcgcctcgagttgctcgacggcctggcgccggtcgagcgaatcggggccgaccaggccatcgatcgcgagccggccctggcgccggtcggtaaccggctggccggggcaatcctgtttcctgatcacgaatgcggcgatgcctgcctgttcagtcagggcgtggtccgaatcgccgaaaggatgggcgccgaattgcgcctttccacacgggttaccggaatcatccgtgaccgggacgggttccgggccgtggataccgaccatggccgcttccaggccgatgcctgcgtactggctgccggcccggatgcggcgaagctggcgcgcagcgcgggtgtgcggctgccgatctacccggtgcgtggctattcggcgaccttcgaactcgatgaccccgggccggccccgcacatgccgatgctcgacatggccagtcgctttgtgacgctgcgcctgggcgagcggcgcctgcgcgtggccggcctggccgattttgccggccatcgcaaggacattcccggccatcgaatcgaatccctgcttgccggagcgcgcaagctgctgccggcacttgccgatgagctggtcaccgaacgggccgggttgtgggccggcctgcggccggtcacgcccgatggcctgccgctgttgggtccatccagggtcaggggcttgtacgtcaatgccgggcatggcccgatgggctggaccatggcctgcggttcggcgcgcgtgctggccgacctggtcgccggcaaatcacctgaaatcgacgtgcgcgactttgccgttcatcgctga

SEQ ID NO: 732 - protein, 419 aa, Unknown
  Obtained from environmental sample
  DOMAIN (2)...(402): FAD dependent oxidoreductase
  SITE (137)...(140): N-glycosylation site. Prosite id = PS00001
MHVIVIGAGVVGAATTLALVERGVRVTLIDRRPEAAAETSHANGGGITPLHSEPWNAPGLLGKLVHNVGRPDSPYKLYPLAVPGMGLWGAKFLVHMRKTRFVANARRNFRLGLYSLDCLRRWVQTYDIDFHRASNGSLQVYFDPELLDQAMRLRLELLDGLAPVERIGADQAIDREPALAPVGNRLAGAILFPDHECGDACLFSQGVVRIAERMGAELRLSTRVTGIIRDRDGFRAVDTDHGRFQADACVLAAGPDAAKLARSAGVRLPIYPVRGYSATFELDDPGPAPHMPMLDMASRFVTLRLGERRLRVAGLADFAGHRKDIPGHRIESLLAGARKLLPALADELVTERAGLWAGLRPVTPDGLPLLGPSRVRGLYVNAGHGPMGWTMACGSARVLADLVAGKSPEIDVRDFAVHR

SEQ ID NO: 733 - DNA, 1257 bp, Unknown
  Obtained from environmental sample
atgcatgtcatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccgggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaacacccgcctggcggtatattccggtcactgtttgaaagccctgcgcgagcgattcgagctgaactatcaccaatacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcagccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 734 - protein, 418 aa, Unknown
  Obtained from environmental sample
  SIGNAL (1)...(18)
  DOMAIN (2)...(400): FAD dependent oxidoreductase
MHVIVIGAGVVGSTTALALAERGLEVTLIERHGEPGAETSHANGGGITPGHAEPWNSPGIIRRLLTRSGEGEPFRIRPGALPGLSGWGLRFLANSRPGRYYFNARANTRLAVYSGHCLKALRERFELNYHQYTDGSLELYFSQAELDHALELRRRIGDPGVEIHLLGVREAVALEPALEPIAARLVGAMQLPLHESGDACEFSAEMVRCARSLGARVLFDTEVVTINRNNDRISGVQTDKETINTDAVVLSAGCASPSLARPLGLRLPIYPVKGYSATLELDQVELAPTMPLLDLEQRIVTARYGRRLRMAGLADFEGHDRSVRPERIARLLESAATLLPALADEIHSGKAEPWAGLRPMTPTGPPMLGPTRIPGLYLNTGHGSMGWTQAAGSAEVLADLVTGKTPVIDMRGLEAVKG

SEQ ID NO: 735 - DNA, 807 bp, Unknown
  Obtained from environmental sample
aaagaattcggcacgagcatcagtgcggccacattggcgcttgccgcccgaccggcccaaagctggaccgcacttgtggccaccgcctcgctcaagtccggactcgagttgttgaaacgattgcgaaaacacatgggcgagaccctgtcggcctgtgaattcatgccgcgcctggccatggagttcgtgctcgagtacctgggttcggcccgcgatcccttcaatgggccgcatccctggtatgtgctggtccaagtcgacagcgccatggatggagactggctggagacgcgcttgctggacatgctgcaggacaccctgtctgaaaaaatcatcagcgatgtcgtggtcgctgacagcatggccaaagccggtcagctttggcggctgcgtgaatcgatctcgcccgcccaacaaacaggtggcgccagtctgaaacacgatatttccgtaccggtgtcaagcattccggccttcgtcgaccaggccagcagtgatctggccaaggcggttccggggattcgaccgtgcatcttcggccacctcggcgacggcaacctgcacttcaacctcagccagcccgaggccatgcaagccgatcaattccgcgcactggaaagtcgctgcaaccgcatcgtgttcgaccttgtccgacaattcaacggctccatcgccgccgaacacggcattggccaattgcgtcgcgaagaattggccaccggccagccactgaaggtcgacctgatgcgcgccctgaagaagtcactggacccgcacggcctgctcaaccccggaaaggtcgtctga

SEQ ID NO: 736 - protein, 268 aa, Unknown
  Obtained from environmental sample
  SIGNAL (1)...(21)
  DOMAIN (17)...(267): FAD linked oxidases, C-terminal domain
  SITE (192)...(195): N-glycosylation site. Prosite id = PS00001
  SITE (224)...(227): N-glycosylation site. Prosite id = PS00001
KEFGTSISAATLALAARPAQSWTALVATASLKSGLELLKRLRKHMGETLSACEFMPRLAMEFVLEYLGSARDPFNGPHPWYVLVQVDSAMDGDWLETRLLDMLQDTLSEKIISDVVVADSMAKAGQLWRLRESISPAQQTGGASLKHDISVPVSSIPAFVDQASSDLAKAVPGIRPCIFGHLGDGNLHFNLSQPEAMQADQFRALESRCNRIVFDLVRQFNGSIAAEHGIGQLRREELATGQPLKVDLMRALKKSLDPHGLLNPGKVV

SEQ ID NO: 737 - DNA, 1242 bp, Unknown
  Obtained from environmental sample
atggcccgcaaaatcatcgttcttggtgccggcatggtcggcgtatccgtagcctggcatctggtgcgtcgcggtcatgacgtcacgctggtggaccgccgcgaaccgggcctcgagacctccttcggcaatgccggcatcatccagcgcgaggcggtgcgcccctacgccttcccccgtgatgtcgccaccctgctgcgggtggtgcccaaccgccaggtggacatccgctaccgtcccaccggcatgctcagcgcggcgggcccgctgctgaactactggctgaactcgagcggtaagcgctacgagcgcatcgtgaccgagtgggcatcgctgatcatgcgctgccaggatgcccacgcgccgatgatcgaagccgccggcgccgaggcgctggtgcgcaaaggcggctggctggagctttaccgcacccagaaggagttcgaggagcgccagaaagaagctcaggaaaaccacgagcgcttcggggtcgagtttgaagcgctggacgccgaggcgctctacgccaaggagccgcatctggccaaggggctggtcggggcgatccactggacgcagccctggatggtctcagacccgggcggcctggtgcaggcctacgcccgcagctttgccgcacagggcggccaggtgaagcaggccagcgtcgaggatgtgctccaggtagagggcggctggcgagtcaataccagcgaaggccccatggaggcagagcaggtggtggtggccctgggcccctgggccggagaactgctgggcaggctgggcatgaaagtgccgctgttcgtgaagcgcggctaccacatgcactactccgccgaaggggaagccaagctcaaccactgggtgatggatgccgagaggggcttcctgctcgaaccgatgcgcgccggcattcgcctgaccaccggcgccgagctggccgacctggaatcaccgccccagtacaagcagctggccgccgccgagaaggtggcccgcaagctgttcccgctgggcaagcgtcgcgacagccagccctggaaaggcgcccgcccctgcctgcccgacatgaagccagtgatcggccccgcccccaacaaggaagggctgtggctcgcctgcggccacggccaccagggcttcaccctgggcccggccaccggcgaactgctcgcccagatgatggatggcgaagagcccgcggtggatatggcaccgttccgggtcgatcgattctga

SEQ ID NO: 738 - protein, 413 aa, Unknown
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001
MARKIIVLGAGMVGVSVAWHLVRRGHDVTLVDRREPGLETSFGNAGIIQREAVRPYAFPRDVATLLRVVPNRQVDIRYRPTGMLSAAGPLLNYWLNSSGKRYERIVTEWASLIMRCQDAHAPMIEAAGAEALVRKGGWLELYRTQKEFEERQKEAQENHERFGVEFEALDAEALYAKEPHLAKGLVGAIHWTQPWMVSDPGGLVQAYARSFAAQGGQVKQASVEDVLQVEGGWRVNTSEGPMEAEQVVVALGPWAGELLGRLGMKVPLFVKRGYHMHYSAEGEAKLNHWVMDAERGFLLEPMRAGIRLTTGAELADLESPPQYKQLAAAEKVARKLFPLGKRRDSQPWKGARPCLPDMKPVIGPAPNKEGLWLACGHGHQGFTLGPATGELLAQMMDGEEPAVDMAPFRVDRF

SEQ ID NO: 739 - DNA, 1245 bp, Unknown
  Obtained from environmental sample
atgtctcgtcaaaccgtcgtcctgggagccggcatggtcggcgtttccatcgcctggcacctggcccgtcgcgggcgttcggtgctgctggtggatcgccttccgcccggtcgcgagacctcctatggcaacggcggcctaatccagcgcgaagcggtgcgcccctacaccttcccccgcgagctgggcaagctgctcgattcgctgcccaaccggcgggtcgacattcgctatcagtggcgcggggtgctgcagttcgccgggccgctgctgggctactggcgccattcggctccccgccgctacgctcgcatcgtttccgagtatgcctcgctgatcgcgctgtcgacccaggagcatgcgccgatgatcgaagccgccggggcaggagagctgatcggcaaggagggttggctcgaggtgcatcgcagccaggcggaactcgaccgtcgggccctcgaggcggaggattccgcccggcgtttcggcgtgacctacgacgtgctcgacggccggggcctggcgcacaaggagcctgctctcggcgatgggctggccggggcggttcactggaccaactcctggagcgtggccgacccgggcggactggtggctgcctacgcccgcagcttccagcaactggggggagagatcctgcaggcggaagtcggcagcgtgagccaggcgggcgccggctggcacgtcgacaccgaccggggcggtctcgaggccggcgatctggtggtggccctggggccgtgggcgggcgcctggctgagggatcttggctaccacctgccgaccttcgtcaagcgcggctaccacatgcactacggtgcggcggaggagcagcgcatcaaccattggctggccgatgccgacatcggctacatcctggcgcccatgcgggccggcattcgtctgaccaccggggcggagctggctccgctggatgcgccgcccgcccacgatcagttggcggcagccgagcgtcgagcgcgcgagctctttcctggcctggggcagcgcctggaggagcagccttggaagggtgcgcgcccctgcctgccggacatgaagccggtgatagggccggcgccgcagcatgcggggctgtggttcgccttcggccacgggcaccagggcttcaccatggggccggccacggggcgcgtgctgagcgagatgatggaaggggagccgacggcggtggatatggcgccctttcgcgccgaccggttttga

SEQ ID NO: 740 - protein, 414 aa, Unknown
  Obtained from environmental sample
  DOMAIN (4)...(396): FAD dependent oxidoreductase
MSRQTVVLGAGMVGVSIAWHLARRGRSVLLVDRLPPGRETSYGNGGLIQREAVRPYTFPRELGKLLDSLPNRRVDIRYQWRGVLQFAGPLLGYWRHSAPRRYARIVSEYASLIALSTQEHAPMIEAAGAGELIGKEGWLEVHRSQAELDRRALEAEDSARRFGVTYDVLDGRGLAHKEPALGDGLAGAVHWTNSWSVADPGGLVAAYARSFQQLGGEILQAEVGSVSQAGAGWHVDTDRGGLEAGDLVVALGPWAGAWLRDLGYHLPTFVKRGYHMHYGAAEEQRINHWLADADIGYILAPMRAGIRLTTGAELAPLDAPPAHDQLAAAERRARELFPGLGQRLEEQPWKGARPCLPDMKPVIGPAPQHAGLWFAFGHGHQGFTMGPATGRVLSEMMEGEPTAVDMAPFRADRF

SEQ ID NO: 741 - DNA, 1245 bp, Unknown; identical to SEQ ID NO: 739
  Obtained from environmental sample

SEQ ID NO: 742 - protein, 414 aa, Unknown; identical to SEQ ID NO: 740
  Obtained from environmental sample
  DOMAIN (4)...(396): FAD dependent oxidoreductase

SEQ ID NO: 743 - DNA, 1242 bp, Unknown; identical to SEQ ID NO: 737
  Obtained from environmental sample

SEQ ID NO: 744 - protein, 413 aa, Unknown; identical to SEQ ID NO: 738
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001

SEQ ID NO: 745 - DNA, 1146 bp, Unknown
  Obtained from environmental sample
atgacccattccgacatcctgattattggcggcggcatcgccggtatgtctgcggcattctttctggcaaagaccggaaagtccgtcacggttctggaacgcgaagaccagcccgggtatcacagcaccggccggtctgcggctctgtatagcgaaacctatggccccaaaatcattcgcaagatgtcgacggcaagccgggatttcttcatcgccccgcccgacgggtttaccgaccacccgatcctgaccccgcgcggcatcatcatgaccgccgcccccggcgaagaagccaaacttgacgaaatcctgaccgaaggccgcgcaaacggggcaaattttgtttccctgaccccggccgagctcaaagaaatcatcccggtgatcaataccgatctgattgccagtgcggcccatgaaactgatgccatggacatcgatgtccatgcgctgcattggggctttatccgccagttcaaatcactgggcggtacgctgatcaccaaggctgatgtcagtgcgatcagcaaaacaaatggcacatggcaggtaacccttggcaatgggcaaacgcacagcggtgatatcatcgtcaatgccgcaggcgcatgggtcgatgacatcgccaccaaggccggtatcaaaccgcttggcattacgcccaaacgccgcacagccgtgatggtggatttgccagccgatgtgaatgcccatggctggccactggtcgccagccttgatgaaagcttgtatttcaaggaagacgccggacggttgctggtctcccccgccgacaccaccccgaccgaaccccatgatgtccagcccgaggaactcgatatcgcgatcacgattgaccggctgatgaccgcaaccagcatcgaagtccgccgtcccggagaaagctgggccgggttgcgcagcttttttgccgatggcgatccggtttcagcatttgatccggccgatggcagtttctattggctggccggtcagggcggatatggcattcaaaccgcaccggccatgggggaatatgccgccagcctgatctgtggcaacggcatcccggcccatatgcaaaagcttggcattaccgaggatgcgctctcggcaacccgcccgtcgctggtgaccgggaaataa

SEQ ID NO: 746 - protein, 381 aa, Unknown
  Obtained from environmental sample
  SIGNAL (1)...(23)
  DOMAIN (5)...(350): FAD dependent oxidoreductase
  SITE (131)...(134): N-glycosylation site. Prosite id = PS00001
  SITE (181)...(184): N-glycosylation site. Prosite id = PS00001
MTHSDILIIGGGIAGMSAAFFLAKTGKSVTVLEREDQPGYHSTGRSAALYSETYGPKIIRKMSTASRDFFIAPPDGFTDHPILTPRGIIMTAAPGEEAKLDEILTEGRANGANFVSLTPAELKEIIPVINTDLIASAAHETDAMDIDVHALHWGFIRQFKSLGGTLITKADVSAISKTNGTWQVTLGNGQTHSGDIIVNAAGAWVDDIATKAGIKPLGITPKRRTAVMVDLPADVNAHGWPLVASLDESLYFKEDAGRLLVSPADTTPTEPHDVQPEELDIAITIDRLMTATSIEVRRPGESWAGLRSFFADGDPVSAFDPADGSFYWLAGQGGYGIQTAPAMGEYAASLICGNGIPAHMQKLGITEDALSATRPSLVTGK

SEQ ID NO: 747 - DNA, 1278 bp, Unknown
  Obtained from environmental sample
ttgaaaattgtcgttgtaggcgctggcatcataggcgtcaccaccgcgtatgaattggccacgcgcggccatgaggtcactttactcgacgggcgggcaggggcggggcttgagacgagctacgccaatggcggtcaactcggtgcgagcgaagtcgcgccttgggcggggccggaagtgccgtggctggtgctgcgttggcttggccgtgcggatgctcctttcaggttgaaactgaaatcggatccggagcaatggctctggctgatgcgtttcctcatgcgctgccgcaaatctgcgcgcgccgaacgcgtcatgcccaatctcgctctggcgctactgtctcagtcgcgcatggacgagatcgcgctgcaaatgaacaacgatccgatagactatgacgaacggcgtgatggcatcctccagattttccatcgcgaacggagcctgaaagaagccgcgtcatccatcgacacgatgcaggatgcaaggctggagcaacgagtgatgtcggcgcgcgaatgcgtcgatctggagcctgctcttgaggaggcgtttgcccggggcaatattgtggggggcatattctgttccagcgaccgcagcggcgatgctcacaaatacacacatcaattggcagagcgcgcgcaacaactcggcgtagcctttgttggagaagctgaggtgacgggctttgaaacgtctggggaccgtattaccggtgtacaaacccgtgcctggacgttcaatgcagacgctgtcgttcttgcagccggtgttcacaccgcgcgacttgcgcgcatgtgcggcacacggataccggtctatccgctcaagggttattcggtgactttgccaacagatggcatcaaggcgccgcgggtgagcctcaccgacgaagcccgcaaggtggttgtcagtcgtctgggcgatcgattacgcaccgccggtacggcagaagtaagcggctatgataccgagatcgaactggctcgcgctcgctcagtgctggatgccaccacggatatttttccacaaatgaagccggtcgaagacaaggccgaatattggacaggtctgcgtcctatgacgcctgatggaagcccgattcttgggcaagccgggcagttcaataatctctatctcaacacaggccacggctcattgggctggacaatggcggctggcagcgccgtaggcgtcgcagacgcaatctgcggcagggtgtctcagctggatctaacccctttcagcataacaagattttcgcttatctga

SEQ ID NO: 748 - protein, 425 aa, Unknown
  Obtained from environmental sample
  DOMAIN (2)...(404): FAD dependent oxidoreductase
  SITE (259)...(269): Regulator of chromosome condensation (RCC1) signature 2. Prosite id = PS00626
MKIVVVGAGIIGVTTAYELATRGHEVTLLDGRAGAGLETSYANGGQLGASEVAPWAGPEVPWLVLRWLGRADAPFRLKLKSDPEQWLWLMRFLMRCRKSARAERVMPNLALALLSQSRMDEIALQMNNDPIDYDERRDGILQIFHRERSLKEAASSIDTMQDARLEQRVMSARECVDLEPALEEAFARGNIVGGIFCSSDRSGDAHKYTHQLAERAQQLGVAFVGEAEVTGFETSGDRITGVQTRAWTFNADAVVLAAGVHTARLARMCGTRIPVYPLKGYSVTLPTDGIKAPRVSLTDEARKVVVSRLGDRLRTAGTAEVSGYDTEIELARARSVLDATTDIFPQMKPVEDKAEYWTGLRPMTPDGSPILGQAGQFNNLYLNTGHGSLGWTMAAGSAVGVADAICGRVSQLDLTPFSITRFSLI

SEQ ID NO: 749 - DNA, 1245 bp, Unknown
  Obtained from environmental sample
atgcgcgtaatagtgctgggggccggcgtgatcggcgtgacttcggcgtggtatttggcccaggccgggcacgaaataacggtggtggatcgccaaccggatgccggccttgaaaccagctttgccaacggtagccaaatttccgtgtgccatgcggagccctgggccaacccagcagtgttttccaagttgttgcgttggttggggcgggaggatgctcccttgctgtggcgtttccgtttggacccggctcaatgggcctggggacttcgcttcctggctcagtgcggccctacccgaacccggcagaacatcgaggcactggttgcccttggtttgcacagccggaccagtttgcaggtgctccgtacggagttgaacctgcaatacgaccagttggaaaagggcattctgcatttctataccgatgcccgggaatttgagcatgcccgtccccaggcggaactcatgactcaactgggctgtccccgtcgggtagtttccacggctgaatgtctggctctggagccggcattgcaacacattgggccgaagattgtggggggcacctacaccccggatgacgagtcgggcgatgcgcggaagttcacccagcagttggcccagcgctgtgtttctgcgggtgtcgtattccgttatgggagcacgattgccgccatccaggctgaggccgggaaaatcagcggggttcgcctggccggcggcgaagtgttggcggcagatgcctacgtattggcgttaggcagctatgcaccactattgacggcttccttgggcatgtccttgccggtgtatccggcgaagggttactccatcactattcccttggccgaggggagcgaggcgccgatggttagtctcaccgacgacggttacaagctggtgtattcccgcctcgggcaacgcttgcgggtggccgggacggcggaattctgtggctacgataccagcctcaaccgggcaaggctggaggccttgaaggtgcggacgaaggaggtttttcccactttgaaggcggctggcgaaatcgaagaatggaccggcttgcggcccgctacgccggggaacgtgcctttggttggtgccagccgttattccaatcttttcctgaatgtcggtcacggcaccctggggtggaccctggcctgcggttcggggcagttgctggctgacctagttagcgggaaggcaccggcaattgacccggttcgttatcggccctga

SEQ ID NO: 750 - protein, 414 aa, Unknown
  Obtained from environmental sample
  DOMAIN (2)...(399): FAD dependent oxidoreductase
  SITE (43)...(46): N-glycosylation site. Prosite id = PS00001
MRVIVLGAGVIGVTSAWYLAQAGHEITVVDRQPDAGLETSFANGSQISVCHAEPWANPAVFSKLLRWLGREDAPLLWRFRLDPAQWAWGLRFLAQCGPTRTRQNIEALVALGLHSRTSLQVLRTELNLQYDQLEKGILHFYTDAREFEHARPQAELMTQLGCPRRVVSTAECLALEPALQHIGPKIVGGTYTPDDESGDARKFTQQLAQRCVSAGVVFRYGSTIAAIQAEAGKISGVRLAGGEVLAADAYVLALGSYAPLLTASLGMSLPVYPAKGYSITIPLAEGSEAPMVSLTDDGYKLVYSRLGQRLRVAGTAEFCGYDTSLNRARLEALKVRTKEVFPTLKAAGEIEEWTGLRPATPGNVPLVGASRYSNLFLNVGHGTLGWTLACGSGQLLADLVSGKAPAIDPVRYRP

SEQ ID NO: 751 - DNA, 912 bp, Unknown
  Obtained from environmental sample
ttgccgcgcacggtacgatttgggaaggcgcttgtggaaaaacattatcaggttgtcatcgtcggcggtgggccggtgggcatggcgctcgccatcgatctcggattacgcggcatctcctgcgcattgatcgaaagccggaccaagggacacttgatcccgaagggccagaaccttacccagcgcacgctggaacatttttacttctggggcatcgtcgatgaattgcgcgcctcgcgtgtcatgccacgcgacgccgcgatcggcgagatcacggcctatggggatctcaccagtgaatactggcaggcggcggcgggccgcgagatcgtgcggccttactacttccaggacaacgaccgcatgccgcagtaccagatggaagcggtaatggcggcgaaacttgcgtcgatgaagaatgtcgatgtgcggatcggctggtcggccgtggccgtcgaacaggatgcgggcggcgcgaaggtcgagattgcggaagaggctggtccgggccgcgacgttttcagcgcggaatacgttgtcggttgcgacggcgcgcgttcgctggtgcgcgagcaggccggcatttcccgcagcggcacggtgttcgataagctcatggtgctgatggtgttccgctcgcgcgaactgcacgagcggctgaagcgctttccgcagcgctccgtctatcgcgtgatgcatccggatttcgaaggctactggcagttcttcggccgtatcgatgtcggtgagagcttctttttccatgcgccggtgccgcgcgacaccaaacgcgaaaacttcgatttcatggggccgctgcgccgcgccgccggtttcgatttcaagaccgagttcgactacaccggcttctgggagctgcgcaacgaagtcgccgagatctactcgtgccga

SEQ ID NO: 752 - protein, 304 aa, Unknown
  Obtained from environmental sample
  DOMAIN (15)...(302): FAD binding domain
  SITE (58)...(61): N-glycosylation site. Prosite id = PS00001
MPRTVRFGKALVEKHYQVVIVGGGPVGMALAIDLGLRGISCALIESRTKGHLIPKGQNLTQRTLEHFYFWGIVDELRASRVMPRDAAIGEITAYGDLTSEYWQAAAGREIVRPYYFQDNDRMPQYQMEAVMAAKLASMKNVDVRIGWSAVAVEQDAGGAKVEIAEEAGPGRDVFSAEYVVGCDGARSLVREQAGISRSGTVFDKLMVLMVFRSRELHERLKRFPQRSVYRVMHPDFEGYWQFFGRIDVGESFFFHAPVPRDTKRENFDFMGPLRRAAGFDFKTEFDYTGFWELRNEVAEIYSCR

SEQ ID NO: 753 - DNA, 1248 bp, Unknown
  Obtained from environmental sample
atggcacgtaccgatgcaatcgttctgggcgccggcattgtcggcacgtcggtcgcgctgcaccttgtgaaacgcgggctttcggtcgcgctgatcgaccggcgcgggccgggcgaggagacgagctacggcaacaccggcgtcatcgtcggcgcgagcgtgttcccgacggcgtttccgcgcagcctgaagaagctcattcaggtggcgctcaagcaggcgccggaggcgaactatcaccttagggacctgctcaaggtcgcgccctggctgatctcgtatttcaatttctccacgcccgagaagctcaaggagagcgccgtcaagctgcggccgctgatgagccattcggtcgccgagcacaaggtgctgctcgaagagtccggcgcgatgaaatatttccgcgagaccggctggatcacgctctatcgttccgacgcggccttcgaggcgatgcagccgcagctcgagttcggcgcgaagatcggcgttgcggcgcaggcgttggatatgaacggcacgctcgcgctcgagccgagcctcaatccggtgttccgccacgcgctgatgtggccggacgtcgcctcgctctccaatccgctgatggtgacgcgcgcctatgcgaagcgtttccaggcgctcggtggcgtgctgctcaagggcgacgcccgcaaggtgcatcgcgccgagggccgctggcgcgtcgacaccgaggaagggcccgtcgattcggcgaatgccgtggtggcactcgggccgtggtcgcccgacgtgctcgagccgctcggcatcaaggtgccgctcggcatcaagcgcggctatcaccggcatttcaacgcgaagggcaacgccgcgctgtcgcggccgatcatcgataccgagatcggctatgcgctgacgccgatggagcaggggatccggctgacgactggcgccgagttcgccgaccgcgatgcgccgccgacgccggtgcagttcgaccggctgatgccgcgcgccaaggagctgtttccgctcggcgagccgaacgaggccgagccctggctcggccgccgcccgaacatgccggactcgctgcccgtgctcggccgcgctccggggcaggacgggctctggctggcgttcggccacggccactgggggctgacgatggcgggggtgacggggcggctgatcgccgagctgatgaccggtgcgacgccgttcgtcgatccgacgccatatcgggcggagcggttcggttcttag

SEQ ID NO: 754 - protein, 415 aa, Unknown
  Obtained from environmental sample
  DOMAIN (5)...(395): FAD dependent oxidoreductase
  SITE (97)...(100): N-glycosylation site. Prosite id = PS00001
  SITE (174)...(177): N-glycosylation site. Prosite id = PS00001
MARTDAIVLGAGIVGTSVALHLVKRGLSVALIDRRGPGEETSYGNTGVIVGASVFPTAFPRSLKKLIQVALKQAPEANYHLRDLLKVAPWLISYFNFSTPEKLKESAVKLRPLMSHSVAEHKVLLEESGAMKYFRETGWITLYRSDAAFEAMQPQLEFGAKIGVAAQALDMNGTLALEPSLNPVFRHALMWPDVASLSNPLMVTRAYAKRFQALGGVLLKGDARKVHRAEGRWRVDTEEGPVDSANAVVALGPWSPDVLEPLGIKVPLGIKRGYHRHFNAKGNAALSRPIIDTEIGYALTPMEQGIRLTTGAEFADRDAPPTPVQFDRLMPRAKELFPLGEPNEAEPWLGRRPNMPDSLPVLGRAPGQDGLWLAFGHGHWGLTMAGVTGRLIAELMTGATPFVDPTPYRAERFGS

SEQ ID NO: 755 - DNA, 1245 bp, Unknown
  Obtained from environmental sample
gtggcacgcacagatgcaatgattttgggcgccggtattgtcggcacatcggtcgcgctgcatctcgcccgacgggggatgagcgttgcgctcgtcgatagagccagcgtcggcgagcagacgtcctatggcaacgccgggatcatcgaaggcaacacaatattcccacccgcatttccatcggatgttggcagccttgtccgcatcgcgctcaagcgcgcgagcgaggcgaactaccacatttcatttctgccgcatgtcctgccgtggttgctggcgttccgcgaagcctcgcggccggagcgcctggcagagaccgcgcgattgatccgtccgctattttcgcgcgcagtcgtcgagcatgagactttgatggccgaagccggagcaacacactacctgcgcaagacgggttggctcaaagtctatcgtgggaaaaagagcgtagctgccttggcaccggaattcgagctcgccgcgaaatttggtttgccactggatgcgctcgacatggccggggcgctggcacttgagccctcgcttcatccggtgttcgcccacgccgtgttttggccggaggcggcgagcgtgagcaatccgctcggcgtgacgcgcgcttatgcggcgcgctttgccgcactcggcggtgtcattctctcaggagatgcgcgatcgttgcaccggacgggaaatcgttggcgggtcgagaccgacgaaggtgcactcgactcagcggagtgcgtcgtcgcattgggtccgtggtcgtcggacttgctcgcgaggtttggtctaagactgccgcttgcggtcaaacggggttaccatcggcattttcgcgcgcaaggtaatgccggtttggcacgcccggttctggacgccgaagtcggttatctggtcacgccgatggaacaaggtatccgcataaccaccggggctgaattcgctgcacgggatgcaccgccttcaccggcccagttcgatcggatcatgcctcgagcgcgccaattgtttcctctgggggagcgcgctgacggaaagacctggcttgggagccgtccttgtttgccggattcgcgaccggtgatcggccgcgctcctgggcaagcgggactatggctcgcgctcggtcacgcccactggggtctcactttaggccccgccacaggacgcatgattgcagagatgatgacgggcgtgccgccattttgcgatcccgctccctatcgtgcggaacgtttcagctag

SEQ ID NO: 756 - protein, 414 aa, Unknown
  Obtained from environmental sample
  DOMAIN (5)...(395): FAD dependent oxidoreductase
MARTDAMILGAGIVGTSVALHLARRGMSVALVDRASVGEQTSYGNAGIIEGNTIFPPAFPSDVGSLVRIALKRASEANYHISFLPHVLPWLLAFREASRPERLAETARLIRPLFSRAVVEHETLMAEAGATHYLRKTGWLKVYRGKKSVAALAPEFELAAKFGLPLDALDMAGALALEPSLHPVFAHAVFWPEAASVSNPLGVTRAYAARFAALGGVILSGDARSLHRTGNRWRVETDEGALDSAECVVALGPWSSDLLARFGLRLPLAVKRGYHRHFRAQGNAGLARPVLDAEVGYLVTPMEQGIRITTGAEFAARDAPPSPAQFDRIMPRARQLFPLGERADGKTWLGSRPCLPDSRPVIGRAPGQAGLWLALGHAHWGLTLGPATGRMIAEMMTGVPPFCDPAPYRAERFS

SEQ ID NO: 757 - DNA, 1251 bp, Unknown
  Obtained from environmental sample
atgcaggacattctcgtgcttggcgccggtatggttggcgtttcaaccgcgctggcgctgcaggggcgcgggcataaggtggtgctggcggacaggaggctaccgggcgaggaaaccagctacggcaatgccggtgtcattcaggccgaggccgcagagccctatgccatgccgcgtgatttgccaacgctcctgcgatatgtgctcgggcagagcaatgatcttgtctggtccccggccggtattgccgtcatggcccctgccctgtggcgctacttccgggcctcagccccggcgcggcaccgggcagtctctgccgtttacagccagctgacggcgcaggcctgcaccgcccatgcgccgctgatcgaggcctccggcagcggcaacctcatagcccgcgaggggctggccattctgcatcgtgatccgaaggcccttgaagctgctgcaagtgaggcgcggcggttgcaggaagcctatggcgtgccgttccgtgctgtggccggtgcggcctggatgcgcgaggagccttccttgcggcaggcgcccgcaggcgtcattcactacacgggcagctggagctgttccgaccctggaggcctcaccaaggcctatgctgcgctctttgaaagccgtggcgggacaatcgccaccgctgatgctgccacgttgcggcggacatcctccggctggcacgtggcgggtgcagaggggccggtcagcgcgcaaaccgtggtgctctgccttggcccctggaccgggcagcttctgaagcgcttcggcatcaccgtgccgatggtgctgaagcgcggctatcacgcccattttcaggcaccgcagatgccccgccgccccttcctggatgcggccaacggcatcgtcgtggcagccatgcgcaagggcttgcgcctctcatcaggggcagcgcttgtggcgcatggcgccaaggctgatccacgccagttgcgccgggctgaggccagcgtcggcgggctgatcgaactggggccgcgcatcgaggagccgcaatggtccggcacccgcccctgccttccgggcatgctgcccatggtgggcccggtgccgcgcgaaacaggcctgtgggtgaatttcggccatggccatcagggctttacattgggcccggtcacggcggatatcctcgcccgtgcgctggacggagagctgaagcaggatgcccccggcagtctgccccatgccctttccccggccatccagctatcctga

SEQ ID NO: 758 - protein, 416 aa, Unknown
  Obtained from environmental sample
  SIGNAL (1)...(19)
  DOMAIN (3)...(392): FAD dependent oxidoreductase
MQDILVLGAGMVGVSTALALQGRGHKVVLADRRLPGEETSYGNAGVIQAEAAEPYAMPRDLPTLLRYVLGQSNDLVWSPAGIAVMAPALWRYFRASAPARHRAVSAVYSQLTAQACTAHAPLIEASGSGNLIAREGLAILHRDPKALEAAASEARRLQEAYGVPFRAVAGAAWMREEPSLRQAPAGVIHYTGSWSCSDPGGLTKAYAALFESRGGTIATADAATLRRTSSGWHVAGAEGPVSAQTVVLCLGPWTGQLLKRFGITVPMVLKRGYHAHFQAPQMPRRPFLDAANGIVVAAMRKGLRLSSGAALVAHGAKADPRQLRRAEASVGGLIELGPRIEEPQWSGTRPCLPGMLPMVGPVPRETGLWVNFGHGHQGFTLGPVTADILARALDGELKQDAPGSLPHALSPAIQLS

SEQ ID NO: 759 - DNA, 1254 bp, Unknown
  Obtained from environmental sample
atgagcgagaccatcaccgaaagcgagatcgtcgtgctgggcgccggcatggtcggcgccgcgaccgccttggagcttcagcgccggggccgccaggtgacgcttctcgaccgcaaggcgcccggcgaggagacgtcctacgggaatgcgggcgtcatcgaggcgagcccctatgttccgctcgcctttccccgggatccgcgcgagatactgcgctttgccggcaatcggcagccagcgcttcatttccattggcgctttctgccccggattgccccttggctgtacgcgttgttccgcaattcctccgaagcccggctgcgcgagaacggcgcggcagtccattcgctgacgacgcacgcgccgaaattgcatgaggaattgctcagcgaggccggcaagacggacctgttgcgcaagacgggctggctccagctctaccggagcgaagcggcgttcaccgccgacggcctgaaacgcgccctcgccgatgaggcaggatgggcctattcagtgctcgacacgcaagccgctacggagcttgagccgcatctgacgccggcgttccacaaggcggtctactggccctcgatctggtcggtcgctgatccgggcgcggcgacgaaggcggtggcggagcttttcgaggggcagggcggccggatcgcccggatggaggtcctggcggtcgagccggtcagtgccggatggcgcgtgaagaccgggcaggccgagattgccgcgcggcacgtcgtggtcgcgctcggcccgtggtcgatggacctgctgcgcccgctcggctaccgctttccgctggccgtcaagcggggctatcacctgcatttccgggccaggggcaatgccactctgtcgcggccgctggtcgaccttgccaatggctacgtgatcaccccgatggggcagggcatccgcttgacgaccggaatcgagttcgctgatcgcgatgcgccccccacgccggtccaggtcgcgcgcgccgaggaggcggcgcgaggcctgttcccgctcgaatcgcccgtcgacccgcaaccctggatggggcgacgcccatgcctgccggactcgcggcccattatcggcccggcgccgcgccatgacgggttgtggctgaatttcggccatgcccatctcggctttacgctgggtccggtgtcggggcacctgcttgcggaaatgatgaatgggggcacgccgatcgccgatccggcacccttcgccgcgacgcgattttga

SEQ ID NO: 760 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MSETITESEIVVLGAGMVGAATALELQRRGRQVTLLDRKAPGEETSYGNAGVIEASPYVPLAFPRDPREILRFAGNRQPALHFHWRFLPRIAPWLYALFRNSSEARLRENGAAVHSLTTHAPKLHEELLSEAGKTDLLRKTGWLQLYRSEAAFTADGLKRALADEAGWAYSVLDTQAATELEPHLTPAFHKAVYWPSIWSVADPGAATKAVAELFEGQGGRIARMEVLAVEPVSAGWRVKTGQAEIAARHVVVALGPWSMDLLRPLGYRFPLAVKRGYHLHFRARGNATLSRPLVDLANGYVITPMGQGIRLTTGIEFADRDAPPTPVQVARAEEAARGLFPLESPVDPQPWMGRRPCLPDSRPIIGPAPRHDGLWLNFGHAHLGFTLGPVSGHLLAEMMNGGTPIADPAPFAATRF

SEQ ID NO: 761 - DNA, 1242 bp, Unknown
  Obtained from environmental sample
atggcccgcaatatcctcgttcttggtgccggcatggtcggcgtatcggtggcctggcatctggtgcgccgcggccatgacgtcaccctggtggaccgccgcgagccgggcctcgagacctccttcggcaatgccggcatcatccagcgcgaggcggtgcgtccctacgccttcccccgggatatcgccaccctgctgcgggtggtgcccaaccgccaggtggacattcgctaccgccccaccggcatgatgagtgcggcgggcccgctgctgaactactggctgaactcgagcggcaagcgctacgagcgcatcgtgggtgagtgggcgtcgctgatcatgcgctgccaggatgcccacgcgccgatgatcgaggccgccggcgccgaggcgctggtgcgccagggcggctggctggagctttatcgcacccgcaaggcgttcgaggagtgccaggaaaaggccaaggagaaccacgagcgcttcggggtcgagtatgaggtgctggacgccgaggcgctctacgccaaggagccgcatctgggcaaggggctgatcggggcgatccactggacgcagccctggatggtctcggacccgggcggcctggtgcaggcctacgcccgcagcttcgaggcgcagggcggccgggtgaagcaggccagcgtcgaggacgtgctccaggtagaaggcggctggcgggtcgagaccagcgaggggcccctggaggccgatgaggtggtggtggccctgggcccctgggccggcgacatgctggagaggctgggcatgaaggtgccgctgttcgtcaagcgcggctaccacatgcactactcctcggaggagggagccaagctcaaccactgggtgatggacgccgagaaggggttcctgctcgagccgatgcgggcggggattcgcctgaccaccggcgccgagctagccgacctggactcgcccccccagtacaagcagctggccgccgccgagaaggtggcacgcaagctgttcccgctgggtaagcgccgcgacagccagccctggaagggggcgcgcccctgcatgccggacatgaagccggtgatcggtcccgcccccgacagggcggggctgtggctcgccttcggccacggccatcagggctttaccctgggcccggccaccggcgagctgctcgcccagatgatggatggcgaagaccccgcggtggacatggccccgttccgcctcgaccgcttctga

SEQ ID NO: 762 - protein, 413 aa, Unknown
  Obtained from environmental sample
  DOMAIN (4)...(395): FAD dependent oxidoreductase
  SITE (97)...(100): N-glycosylation site. Prosite id = PS00001
MARNILVLGAGMVGVSVAWHLVRRGHDVTLVDRREPGLETSFGNAGIIQREAVRPYAFPRDIATLLRVVPNRQVDIRYRPTGMMSAAGPLLNYWLNSSGKRYERIVGEWASLIMRCQDAHAPMIEAAGAEALVRQGGWLELYRTRKAFEECQEKAKENHERFGVEYEVLDAEALYAKEPHLGKGLIGAIHWTQPWMVSDPGGLVQAYARSFEAQGGRVKQASVEDVLQVEGGWRVETSEGPLEADEVVVALGPWAGDMLERLGMKVPLFVKRGYHMHYSSEEGAKLNHWVMDAEKGFLLEPMRAGIRLTTGAELADLDSPPQYKQLAAAEKVARKLFPLGKRRDSQPWKGARPCMPDMKPVIGPAPDRAGLWLAFGHGHQGFTLGPATGELLAQMMDGEDPAVDMAPFRLDRF

SEQ ID NO: 763 - DNA, 1251 bp, Unknown
  Obtained from environmental sample
atgcacaccattgtcatcggcgccggcgtcgtcggcgccagcacggcgctgagcctggccgaacgcggcattcaggtcaccgtcctggatcgtcacgctgaggctgccgctgaaaccagccatgccaacggtggcggtatcactccgggccacgccgagccctggaacgccccgggcatcgtcaaacgtttgctgacccgttctggtgccggcgagccttttcgcattcatgcccatgccctgccagggctgatcggctggggactcggctttctgtggcagtcaaaggcatcgcgctactacctcaatgccaggaacaacacgcggctggcggtgtattccggccagtgcctgaaacgcctgcgcgagcgccatgcgctcagctaccaccagtacaccgacggctctctggagctctacttcagccaatccgaactggaccatgcgctcgatctgcgccgcaagatcggtgatccgggcgtcgagatccgggttatcagcgtcgacgaagtgcttgccatggagccggcgctcgaaccggttgccgggcggatggtcggtgccatgctgctgccgctgcacgaatccggcgatgcctgcgttttttcagccgagatgctgcgctgtgccaagcagctaggggccaacatccggctgggtgccaatgtcgatcgcatcgaacagcgccagggccgggtggtcggtgttcgccttcatgaccagcaattgctggaagccgatgcggtcgtcgttgccgctggctgcagctcgcctgcgctggtcaaaccgctgggcttgcgtctgccgatctatccggtcaagggctattcggccacgctggcgctcgaacaggccgatctggcaccgaccgttccgctactggacctggaacatcgcatcgtcactgcccgctttggaaaccgcctgcgcatggccggcctggccgactttgacggccaaaatcgcgatatacgacccgaccgactggaactgctgctggcatctgcctgcgccctgctaccgcgcctggccgatgaaatccggtccggccgcgccgaagcctggaccggcctgcgcccgatgacgcccaagggcccgcccttgatcggacccacccgcattccgcgtttgttcctgaacacaggccacggctccatgggctggacccaagcggccggctctgccgagctgctggccgatctggtggcagagaaaaccccggcaattgatatggcgccctatcgcccctga

SEQ ID NO: 764 - protein, 416 aa, Unknown
  Obtained from environmental sample
  SIGNAL (1)...(20)
  DOMAIN (2)...(401): FAD dependent oxidoreductase
  SITE (107)...(110): N-glycosylation site. Prosite id = PS00001
MHTIVIGAGVVGASTALSLAERGIQVTVLDRHAEAAAETSHANGGGITPGHAEPWNAPGIVKRLLTRSGAGEPFRIHAHALPGLIGWGLGFLWQSKASRYYLNARNNTRLAVYSGQCLKRLRERHALSYHQYTDGSLELYFSQSELDHALDLRRKIGDPGVEIRVISVDEVLAMEPALEPVAGRMVGAMLLPLHESGDACVFSAEMLRCAKQLGANIRLGANVDRIEQRQGRVVGVRLHDQQLLEADAVVVAAGCSSPALVKPLGLRLPIYPVKGYSATLALEQADLAPTVPLLDLEHRIVTARFGNRLRMAGLADFDGQNRDIRPDRLELLLASACALLPRLADEIRSGRAEAWTGLRPMTPKGPPLIGPTRIPRLFLNTGHGSMGWTQAAGSAELLADLVAEKTPAIDMAPYRP

SEQ ID NO: 765 - DNA, 1182 bp, Unknown
  Obtained from environmental sample
cggcacgaggccatagccgggccgggccaggtgttgctcagcctggaacgcctgtccggcctgcgccggcttgaccgggccgatgccagtgtcgtggtcgaggccggctgtaccctggccgccttgcgccaggcagccgctgcggccggcctggtctatccggtcagcctggcctcggagggtacggccacgatcggcggcaccattgcgaccaacgccggcggcaatctgaccattcgctacggcaatacccgcgaccaggtgctgggcctggaagtggtgctggccgatggccggatctggtccgatctcgagccgctgcgcaaggacaacagcggctatgagatcaagcaatggtttatcggcagcgagggcacgttgggcatcatcaccgccgccgccttgcgtctggcaccggcgccgcgccagagcgtgaccgccatgctgagctgtgccgacctggtcagcggcatggccctgctcgaacagctgcgcgccggcctgggcgaatgcctgtcggcctgcgagttcatgccgcgcctggcgctggagttcgtgcttgccgaccaggccggacagcgcgacccgttcaccggcctgcatccctggtacgtgcttgtccaggccgattcggccctgccggggaccggcctggaaacagcggcgctggaggttttcgagcaggcccggaacaagcgcctgtgcaccgaggtggtcctggccagcagccaggcccaggccaatgccctgtggggcttgcgcgagggcatttcggcggcccagaaacacggcggggtcagcatcaagcacgacatttcggtgcccgtggcccgaattccgcgctttgtcgaagaaaccctggcggcactggagcaggccgtgcccgggattcggccatgcgtattcggccatctcggcgacggcaatctccacttcaacctgagccagcccgagtccgtcgacggcgctgctttccgcgccctggagccgatctgcaatcgcatcgtcttcgaccaggtcagacgctaccgcggctcgattgccgccgaacacggcatcggccagctgcgccgcgacgaactggccgacacccggcctctgaaagtcgaactgatgcgcagggtcaagcaggcactggatcccgatgggctgttgaacccgggcaaggtgctgcggccatag

SEQ ID NO: 766 - protein, 393 aa, Unknown
  Obtained from environmental sample
  DOMAIN (2)...(104): FAD binding domain
  DOMAIN (140)...(390): FAD linked oxidases, C-terminal domain
  SITE (77)...(80): N-glycosylation site. Prosite id = PS00001
  SITE (317)...(320): N-glycosylation site. Prosite id = PS00001
RHEAIAGPGQVLLSLERLSGLRRLDRADASVVVEAGCTLAALRQAAAAAGLVYPVSLASEGTATIGGTIATNAGGNLTIRYGNTRDQVLGLEVVLADGRIWSDLEPLRKDNSGYEIKQWFIGSEGTLGIITAAALRLAPAPRQSVTAMLSCADLVSGMALLEQLRAGLGECLSACEFMPRLALEFVLADQAGQRDPFTGLHPWYVLVQADSALPGTGLETAALEVFEQARNKRLCTEVVLASSQAQANALWGLREGISAAQKHGGVSIKHDISVPVARIPRFVEETLAALEQAVPGIRPCVFGHLGDGNLHFNLSQPESVDGAAFRALEPICNRIVFDQVRRYRGSIAAEHGIGQLRRDELADTRPLKVELMRRVKQALDPDGLLNPGKVLRP

SEQ ID NO: 767 - DNA, 1257 bp, Unknown
  Obtained from environmental sample
atgtcactgcatgtgatcgtgatcggtgccggcgtggttggtgccagcacggtgctgagcctggccgagcgcggcttccaggtcacggtcctggatcgccaccctgaagccgccgccgaaaccagccatgccaacggcggcgggatcacgcctggccatgccgaaccctggaatgcgcccggcattatccggcgcctgctgacccgttccggcaccggcgagccgttccgcattcacgctcacgccttgccaggcctggtcggctggggtctcaattttctgtggcagtcgaaggcgtcgcgctattaccgcaatgccaagaacaatacccgtctggcggtgtattccggccagtgcctgaagcgcctgcgcaagcgccatgagctgagctatcaccagtacaccgacggttcgctggagctatacttcagccgctcggagctggaccatgccctggacctgcggcacaagatcggcgatcccggcgtcgagatccggatcatcgatatcgacgaagtcctggccatggagcctgcgcttgagccggtggccgggcgcatcgccggagccatgctgttgccactgcacgaatccggcgatgcccgcgtcttttcagccgagatgctgcgctgcgccggaaacttgggggccaatacccgcctgggtgccgatgtcgagcacatcgaacagcagcagggccgggtggttggagttcgcctccaaggcggtcagctgcttgaagccgatgcggtggtcgtggccgcaggctgcggctcaccggccctggtcaaccccctgggtctgcgtctgccgatctatccggtcaagggctattcggcgacgctggagctggagcaggccgatctggccccgactattccgctgctggacctggaacaccgcatcgtcacggcccgctttggcaaccgcctgcgcatggccggcctggccgactttgacggtgacaatcgcgacattcgctccgaccggttggaactgctgctggcatctgcctgcgccctgctgccgcgcctggccgacgaaatccgctccggccgagccgaaccctgggccggtttgcgcccgatgaccccaaagggtccgcccctgctcggacccacccgcattcccggcctgttcctcaacaccggccacggctccatgggctggacccaggccgccgggtcggccgaaatcctggccgacctgctcaacgacaaaaccccggcgatcgatctggcccccttccttctatag

SEQ ID NO: 768 - protein, 418 aa, Unknown
  Obtained from environmental sample
  DOMAIN (4)...(403): FAD dependent oxidoreductase
  SITE (109)...(112): N-glycosylation site. Prosite id = PS00001
MSLHVIVIGAGVVGASTVLSLAERGFQVTVLDRHPEAAAETSHANGGGITPGHAEPWNAPGIIRRLLTRSGTGEPFRIHAHALPGLVGWGLNFLWQSKASRYYRNAKNNTRLAVYSGQCLKRLRKRHELSYHQYTDGSLELYFSRSELDHALDLRHKIGDPGVEIRIIDIDEVLAMEPALEPVAGRIAGAMLLPLHESGDARVFSAEMLRCAGNLGANTRLGADVEHIEQQQGRVVGVRLQGGQLLEADAVVVAAGCGSPALVNPLGLRLPIYPVKGYSATLELEQADLAPTIPLLDLEHRIVTARFGNRLRMAGLADFDGDNRDIRSDRLELLLASACALLPRLADEIRSGRAEPWAGLRPMTPKGPPLLGPTRIPGLFLNTGHGSMGWTQAAGSAEILADLLNDKTPAIDLAPFLL

SEQ ID NO: 769 - DNA, 1242 bp, Unknown
  Obtained from environmental sample
atggcccgcaatatcctcgttcttggtgccggcatggtcggcgtatcggtggcctggcatctggtgcgtcgcggccatgacgtcaccctggtggaccgccgcgagccgggcctcgagacctccttcggcaatgccggcatcatccagcgcgaggcggtgcgtccctacgccttcccccgggatatcgccacccttctgcgggtggtgcccaaccgccaggtggacattcgctaccgccccaccggcatgatgagtgcggcgggcccgctgctgaactactggctgaactcgagcggcaagcgctacgagcgcatcgtgggtgagtgggcgtcgctgatcatgcgctgccaggatgcccacgcgccgatgatcgaggccgccggcgccgaggcgctggtgcgccagggcggctggctggagctttatcgcacccgcaaggcgttcgaggagtgccaggaaaaggccaaggagaaccacgagcgcttcggggtcgagtatgaggtgctggacgccgaggcgctctacgccaaggagccgcatctgggcaaggggctgatcggggcgatccactggacgcagccctggatggtctcggacccgggcggcctggtgcaggcttacgcccgcagcttcgaggcgcagggcggccgggtgaagcaggccagcgtcgaggatgtgctccaggtagagggcggctggcgggtcgagaccagcgaggggcccctggaggccgatgaggtggtggtggccctgggcccctgggccggcgacatgctggagaggctgggcatgaaggtaccgctgttcgtcaagcgcggctaccacatgcactactcctcggaggaaggggccaagctcaaccactgggtgatggacgccgagaaggggttcctgctcgagccgatgcgggcggggattcgcctgaccaccggcgccgagctggccgacctggactcgccgccccagtacaagcagctggccgccgccgagaaggtggcacgcaagctgttcccgctgggcaagcgccgcgacagccagccctggaagggggcgcgcccctgcatgccggacatgaagccggtgatcggtcccgcccccgacaaggcggggctgtggctcgccttcggccacggccatcagggatttaccctgggcccggccaccggcgagctgctcgcccagatgatggatggcgaagaccccgcggtggacatggccccgttccgcctcgaccgcttctga

SEQ ID NO: 770 - protein, 413 aa, Unknown
  Obtained from environmental sample
  DOMAIN (4)...(395): FAD dependent oxidoreductase
  SITE (97)...(100): N-glycosylation site. Prosite id = PS00001
MARNILVLGAGMVGVSVAWHLVRRGHDVTLVDRREPGLETSFGNAGIIQREAVRPYAFPRDIATLLRVVPNRQVDIRYRPTGMMSAAGPLLNYWLNSSGKRYERIVGEWASLIMRCQDAHAPMIEAAGAEALVRQGGWLELYRTRKAFEECQEKAKENHERFGVEYEVLDAEALYAKEPHLGKGLIGAIHWTQPWMVSDPGGLVQAYARSFEAQGGRVKQASVEDVLQVEGGWRVETSEGPLEADEVVVALGPWAGDMLERLGMKVPLFVKRGYHMHYSSEEGAKLNHWVMDAEKGFLLEPMRAGIRLTTGAELADLDSPPQYKQLAAAEKVARKLFPLGKRRDSQPWKGARPCMPDMKPVIGPAPDKAGLWLAFGHGHQGFTLGPATGELLAQMMDGEDPAVDMAPFRLDRF

SEQ ID NO: 771 - DNA, 1245 bp, Unknown
  Obtained from environmental sample
atgggtgacatcgacgacgtaatcgtgctcggcgccggcatcgtgggcacgacgaccgcgctgaacctgcagcggcgcggccggcaggtaacgctggtcgaccggcgcgggccgggcgaggagacgtcctacggcaatgccggcgtgatcgagggcggtacctatgtgccaattccctttccccgcgatccgctggccgtcctgcgctacgccaccaaccggcattcggcgctgcatttccactggcgcttcctgccgcgcatcgcgccctggctggtcgccctgttccgaaattcctccgaggcgcagcttgtgcagaacggctcggcggtaatgacgctgaccgcccatgccatcgccgagcatcgggcactcttggcgcaggccggtgccgaggggctgatgcgcgatacgggatggctcaggctctatcgcaccgaggccgagttccaggccgacaaactggaaatgcggatcgccgacgagggcggctttccctacacggtgctcaacgctgacgaagcgcgcgaggtcgagccccatttggctccggtgtttgcaagggcggtgcattggggcaccgtctgctcggtgtccgatcccggaggggtgaccagggcggcggccgatctattcacaagggctggaggccgcctcgagcgggccgaggcacggcgcctcacgccggccgatagaggatggcgggttgagaccggggagggagcgctggctgcccgcgaggtcgtggtcgccctcggtccctggtcgatggaattgctgcgcccgctcggcctgcggctgccctttgcgatcaagcgcggctaccacatgcactatcggccccaagggaacgcggcgctgtcgcggccggtggtcgacgggagctatggctacgcgctggcgccgatgaacgccggtatccggctgaccacaggcatcgagttcgccccgctcgacgccgccccgactccggtccaggtcgcccgcgccgaaccgcatgcccgagagctgttcccgctcggcgaggcggtggagcccgaaccctggatgggtcggcggccgtgctttcccgattccaagccggtgaccggcgcggcccccgggcatcgggggttatggcttaatttcggccatgcccatctcggcttcaccctgggtccggtcagcggccggctgctcgccgagatgatgacaggcgaagacccggttgccgatcctgcgcctttcgcgcccacgcgcttttga

SEQ ID NO: 772 - protein, 414 aa, Unknown
  Obtained from environmental sample
  DOMAIN (6)...(396): FAD dependent oxidoreductase
  SITE (99)...(102): N-glycosylation site. Prosite id = PS00001
  SITE (108)...(111): N-glycosylation site. Prosite id = PS00001
MGDIDDVIVLGAGIVGTTTALNLQRRGRQVTLVDRRGPGEETSYGNAGVIEGGTYVPIPFPRDPLAVLRYATNRHSALHFHWRFLPRIAPWLVALFRNSSEAQLVQNGSAVMTLTAHAIAEHRALLAQAGAEGLMRDTGWLRLYRTEAEFQADKLEMRIADEGGFPYTVLNADEAREVEPHLAPVFARAVHWGTVCSVSDPGGVTRAAADLFTRAGGRLERAEARRLTPADRGWRVETGEGALAAREVVVALGPWSMELLRPLGLRLPFAIKRGYHMHYRPQGNAALSRPVVDGSYGYALAPMNAGIRLTTGIEFAPLDAAPTPVQVARAEPHARELFPLGEAVEPEPWMGRRPCFPDSKPVTGAAPGHRGLWLNFGHAHLGFTLGPVSGRLLAEMMTGEDPVADPAPFAPTRF

SEQ ID NO: 773 - DNA, 1242 bp, Unknown
  Obtained from environmental sample
atgtcccgcaatatcatcgttctcggcgccgggatggtcggcgtctcggtggcctggcacctggcgcgccgcggccacgacgtaaccctggtggatcgtcgcgccccgggcctcgagacctctttcggcaatgccggcatcatccagcgcgaggcggtgcgcccctacgccttcccccgggatctcggcaccctgctgcgcgtgctgcccaaccgcgaggtggacatccgctatcgtccgaccggcatggtcggtgcggcggggccgctgctgcagtactggatcaactccggcggggcgcgctacgagcgcatcgttaacgagtgggcctccctgatcgtgcgctgccaggacgcccacgcgccgatgatcgaggccgccggcgccgaggcgctggtgcggaaggggggctggctggagctctaccggacccgcaaggcgctggaagaacggctgcaggaggcccgcgaggatcacgagcgtttcggcgtggagtatgaggcgctggatgcaaaggccctctatgccaaggagccgcacctggccgaagggctggtcggtgccatccactggacccagccgtggatggtggcggaccctggcggtctggtgcaggcctatgcggcgaacttcgaggcgctgggtggccatgtgatgcaggccagcgtcgaggaggtgcatcaggtgggcaccggctggcgcgtcatcaccagcgagggcgccattgaggcgcagcaggtcgtagtggccatgggcccctggagcggcgagctgctgtcacagctgggcctcgaagcgccgctgttcgttaagcgtggctatcacatgcactactcggcggagggagaggccagtctcaaccactgggtgatggatgccgagcggggctttctgctcgagccgatgcgggccggcattcgcctgaccaccggtgcggagctggccgacctggacgcgccgccccagtacaagcagctggcggcggcggagaaggcggcgcgcaagctgttccccctgggcaagcggcgcgatgcccagccgtggaagggtgcgcgtccctgcacgccggacatgaagccggtgatcggcgccgcgcccgggaaggaggacctgtggctggccttcggccacggccatcagggcttcaccctggggcctgccaccggcgagctgctggcccagatgatggatggcgagactccggcggtcgacatgacgccgttccgcttcgagcgtttctga

SEQ ID NO: 774 - protein, 413 aa, Unknown
  Obtained from environmental sample
  DOMAIN (4)...(395): FAD dependent oxidoreductase
MSRNIIVLGAGMVGVSVAWHLARRGHDVTLVDRRAPGLETSFGNAGIIQREAVRPYAFPRDLGTLLRVLPNREVDIRYRPTGMVGAAGPLLQYWINSGGARYERIVNEWASLIVRCQDAHAPMIEAAGAEALVRKGGWLELYRTRKALEERLQEAREDHERFGVEYEALDAKALYAKEPHLAEGLVGAIHWTQPWMVADPGGLVQAYAANFEALGGHVMQASVEEVHQVGTGWRVITSEGAIEAQQVVVAMGPWSGELLSQLGLEAPLFVKRGYHMHYSAEGEASLNHWVMDAERGFLLEPMRAGIRLTTGAELADLDAPPQYKQLAAAEKAARKLFPLGKRRDAQPWKGARPCTPDMKPVIGAAPGKEDLWLAFGHGHQGFTLGPATGELLAQMMDGETPAVDMTPFRFERF

SEQ ID NO: 775 - DNA, 1272 bp, Unknown
  Obtained from environmental sample
atgcgtgtcttggtcataggtgctggtctggcaggcctcacggcggcgtggtatctgcaagagcaaggctgccagatcactatccttgatcgtcgggaggggcccggactcgggacaagttttgcgaatggcgcgcttctgcacccgagcgcatgcgagccatggaacgctccgggcatcctgccaactatcatgaaatcgatcggctcgggtgattcaccgtttttatttcgcgcgaatgcgctgccgagccttctgggatggggcccccgttttctgctcggtagtcgccgcaagcaattcctgaagaccacccagtgcaatacgtctctcgcgctgtacggtatgcgacttcagcgtgagatgcgtgctggcgccgaaatacgtgacggggcctacacgcgtggttcgctgcatttgttccgcagtagcgattcgctggtacgtgcagagcagtgggcccagttgctcaagcagttcggtgtcatttctagagcactcaacgtcgagcagactctggaactcgagcctgcgctgcgcccattgcaggatggcctcgcaggaagcaggcactttgcccaagatgtcagcgccgacgcgcatcgattctgcttcgaactgtcgcgaatcctgcgcgatcgtggcgttcagcttttgtttggttccgctgtgaaacgcgtccttcgaaagggccgacacgtgcatggcattgaaaccgatggtggtcgcgtgctgcacgctgatcgctacctgctcgcggcgggcagcgacagcccgctcatatcccgcaccgtcggcgtccgattaccgattgttccagttaaggggtattcgatcacggtggacggcggaggcgcactcgactttccccaactgccgctcgttgatcgtgatcgacattttgccgttgttcctctcgagaatggccacctgcgcgtcgtcggcttggccgagtttgccggacatgacattcgagttgacgagagaagaatagcgacgctccgtaatcttgtgaccggaattctgccggcgtgtcggccgatgattagcgacggtctagcacaaacgtgggctggccttcgccccatgtgcgcggatggcgcgccgattatcggtcgctcccctgtggagaatctcttcctgaataccggccatggacaacttgggtggacgctcgctgcgggctcggggaagctggtggcggacctgattctcgatcgcgcgcctgaaatcgatccagcgccttttacaccggaccggttcatcttttag

SEQ ID NO: 776 - protein, 423 aa, Unknown
  Obtained from environmental sample
  DOMAIN (2)...(403): FAD dependent oxidoreductase
  SITE (109)...(112): N-glycosylation site. Prosite id = PS00001
MRVLVIGAGLAGLTAAWYLQEQGCQITILDRREGPGLGTSFANGALLHPSACEPWNAPGILPTIMKSIGSGDSPFLFRANALPSLLGWGPRFLLGSRRKQFLKTTQCNTSLALYGMRLQREMRAGAEIRDGAYTRGSLHLFRSSDSLVRAEQWAQLLKQFGVISRALNVEQTLELEPALRPLQDGLAGSRHFAQDVSADAHRFCFELSRILRDRGVQLLFGSAVKRVLRKGRHVHGIETDGGRVLHADRYLLAAGSDSPLISRTVGVRLPIVPVKGYSITVDGGGALDFPQLPLVDRDRHFAVVPLENGHLRVVGLAEFAGHDIRVDERRIATLRNLVTGILPACRPMISDGLAQTWAGLRPMCADGAPIIGRSPVENLFLNTGHGQLGWTLAAGSGKLVADLILDRAPEIDPAPFTPDRFIF

SEQ ID NO: 777 - DNA, 1233 bp, Unknown
  Obtained from environmental sample
atgcaaagcgcaatggttctcggcggcggcatgatcggcgtgagcgcggcgctgcacctccagcagcgcggctgggccgtcacgctcatcgaccgcagggagccgggccgcgagaccagctacggcaacgccggcatgatccaggccgaagcggtgcgtccctatccgatgccgcgcgaccttgcgacgctcctgaagatcgcgaccggccgcaccaacgacgtgcgctacagcctgtcgtcgcttcacctccatatcgagcccctgctccgctactggtggcattcggcgccgaaacggcatcgcgaggcgatcgacgcgtgggcgcgactaatcggctacgcgacgtcggagcacgacattctcattcgcgaggcccatgccgacaatctgatccgccgcgcgggttatcgtgcgctttaccgcgacgccgcggacctcgatctctcgatcaaggccgcggaggacgaccagcgcgaattcggggtgaagtttcgcgtgctctccggcagcgagcttgccagggccgagccgatcctgcgcgacgatcttcccggcgcgatacattggctcgacacctggaccgtgtccgatcccggcgcgcttgtcaccgcctatgccgagctgttcgagcgccgcggcggccgcatcgtgctcggcgatgcgcaatcgctgcggcagaccgcgaccggctggtcggtcgacacggaccagggccgcctcgacgccgcccacgccgtcgtgacgctcgggccgtggtcgcccgatctgctgcagaagttcggctatcgcattccgctggtgcgcaagcgcggctaccacatgcactacagcggcggcgtctcgctcgacctgccgctcgtcgacaagggcagcggctacgccatgggcccgatggccaagggcatccgcatcaccaccggtgccgaattgaccggcatggacgcgctcgccacgcccgtgcagctggccagcgcggaagcctccgcgcgcgagctgatcgacctcggcaaacgcgtcgagccggatccgtggttcggcacccgcccctgcacgcccgacatgctgccggtgctcgggcaagctccgcgtcatcccggcctctggatgaatttcggccacggccaccagggcttcacgctgggacccgcgaccggacgtctgcttgcagaaatcatgagcggcgagacgccggcgattgatccggccccctatcggcccgagcggttctag

SEQ ID NO: 778 - protein, 410 aa, Unknown
  Obtained from environmental sample
  DOMAIN (3)...(392): FAD dependent oxidoreductase
MQSAMVLGGGMIGVSAALHLQQRGWAVTLIDRREPGRETSYGNAGMIQAEAVRPYPMPRDLATLLKIATGRTNDVRYSLSSLHLHIEPLLRYWWHSAPKRHREAIDAWARLIGYATSEHDILIREAHADNLIRRAGYRALYRDAADLDLSIKAAEDDQREFGVKFRVLSGSELARAEPILRDDLPGAIHWLDTWTVSDPGALVTAYAELFERRGGRIVLGDAQSLRQTATGWSVDTDQGRLDAAHAVVTLGPWSPDLLQKFGYRIPLVRKRGYHMHYSGGVSLDLPLVDKGSGYAMGPMAKGIRITTGAELTGMDALATPVQLASAEASARELIDLGKRVEPDPWFGTRPCTPDMLPVLGQAPRHPGLWMNFGHGHQGFTLGPATGRLLAEIMSGETPAIDPAPYRPERF

SEQ ID NO: 779 - DNA, 1233 bp, Unknown
  Obtained from environmental sample
atgaaattcgataccgtggtgctcggcgccggcattgtcggggtgtgcgtcgccgtgcatctgcagaaacgcgggcgcgcggttgcgctgatcgaccgtaagcagccgggcaacgagacctcgttcggtaacgccgggctgatccagcgcgaaggcgtctatccgtacgcgtttccgcgcgggctcggcaccctgctgcgctatgcgcgcaaccagtcgcccgatgtgcgctaccacgccgacgcgatgctccaggctgcgccgtttctttggcgctattggcgcaactcgcatccggcaaagcacgcggaaatcgcgaagtcgtacgcgacgctgatcgagtattgcgtcagcgaacatcgcgcgcttgccgcggacgccggtgcgagcgcgctgctgcggccgatcggctggatcaaggtgtttcgccacgccgccgcgcgcgacgctgaagtcaccctcgccgagcagtggcatcgcgaatacggcgtcgagttcgaaacgctcgacgcgccgcgcctgcaacaactcgaacccgatctcgacaagcgtctgcaaggcgggctgcgctatccgcaatccgattcggtcagcgatccgaacgcgctcgtcaccgcctacgcgcggtacttcgaagcgctgggcggacgcttcttcatcggcgatgccgatacgttgcgcgaaggctggcaggtcgaaacgcgggacggaccgatctcggccgcgtcggcggtgatcgcgctcgggccgtggtcggaccgcgcaagcacgcggctcgggtaccggctgccgctcgcggccaagcgtggctatcacatgcactacgccgcgcgtcggaccgcgcggctcaatcatccgattctcgacgtcgaacacggctatgtgctcgcgccgatggcgcgcggcatccggttgaccacgggtgccgaaatcgcgcgacccgaggccgccaagacgccggtgcaactcgacgcggtcgaaccgatcgcacgcacgctgtttccgctcggcgaacgcctggacgccgaaccgtggatgggacgccgcccgtgcacgccggacatgatgccgatcatcggacccgcgacgaaacatcagggactgtggttcgcgttcggccatgcgcaccatggtttgacgctcggaccggtgacggggcggctgatcgccgagatgatgaccggcgaagagacgctggtcgacccgcggccgtttcgggtcgagcggttttag

SEQ ID NO: 780 - protein, 410 aa, Unknown
  Obtained from environmental sample
  DOMAIN (4)...(392): FAD dependent oxidoreductase
  SITE (38)...(41): N-glycosylation site. Prosite id = PS00001
MKFDTVVLGAGIVGVCVAVHLQKRGRAVALIDRKQPGNETSFGNAGLIQREGVYPYAFPRGLGTLLRYARNQSPDVRYHADAMLQAAPFLWRYWRNSHPAKHAEIAKSYATLIEYCVSEHRALAADAGASALLRPIGWIKVFRHAAARDAEVTLAEQWHREYGVEFETLDAPRLQQLEPDLDKRLQGGLRYPQSDSVSDPNALVTAYARYFEALGGRFFIGDADTLREGWQVETRDGPISAASAVIALGPWSDRASTRLGYRLPLAAKRGYHMHYAARRTARLNHPILDVEHGYVLAPMARGIRLTTGAEIARPEAAKTPVQLDAVEPIARTLFPLGERLDAEPWMGRRPCTPDMMPIIGPATKHQGLWFAFGHAHHGLTLGPVTGRLIAEMMTGEETLVDPRPFRVERF

SEQ ID NO: 781 - DNA, 1272 bp, Unknown
  Obtained from environmental sample
gtgaaggcagggctggaagggtggcaggtgcgcacagttgacgtcatcgtgcttggcgccggcatggtcggaacctcgaccgccctgcagttgcagcgacgggggcttgatgttgcccttgtcgaccgccgccagcccggcgaagagacgtcccatggtaatgccgggatcatagagcgcaacggattcctgccgcccggttttcccggagatgcgaaattcttgctcaacatcgcgctggggcgctggcccggcgccaattacagcctttctgccgtgctgcgtctgctgccctggctgatggcgttccgccgccacggcagccgcacgggtgtgcagcgccttgcccatgcgatgaatgcgctggaggcctatgccatcggcgagcacagggtgctggcggaagccgcggaggcgctgaaatattaccggcagacgggcaccatttacgtctaccgcacggaggcagggttcgaggcgacggcggccgagcgccattatgcccggatcttcggcgtcgattatcacgagctggacgaactcgatctcaacgaactggagccctatctcaccgccgaggggtgccgcggcatcttctggcccgagagcgaatcggtgtccaatcccggcgccgtcaccaaggcctttgcccggtcgctggcggagaagggcggcgagatcctgaccggggatgcaaggcgcttgacgcgctcgcacgggggctgggccattgccacggacaaggggccggtgcgcgggcgcgccgttgccctgtgtctggggccatggtccatggatatcctgaaaggcttcggctaccgcttcccgcttgccgttaagcgcggttaccaccagcactacaaggcgagggcaggggcggggctgtcgcggcccgtggtggatgcggaaatgggctatgtgctggcgccgatggaaaagggcatccgcctgacgacgggcattgaactggccgaacgggatgcggcgccgacgccggtgcaggtggagcgggccttccgcaaggcccgcgagatctttccgctgacggttcctgccgaacccggtgcctggatgggctcacgcccctgtttcccggacagcttgccggtgctgggcgctgcccccggcgaaagcggcctgtggctcaacttcggccatggccattgcggttttacgctggggccggtcaccggccatattctggccgatctcatcaccggcgtgccgccggtcatcgaccctgcgccgctgtcccccctccggtttctgtaa

SEQ ID NO: 782 - protein, 423 aa, Unknown
  Obtained from environmental sample
  DOMAIN (14)...(404): FAD dependent oxidoreductase
  SITE (88)...(91): N-glycosylation site. Prosite id = PS00001
MKAGLEGWQVRTVDVIVLGAGMVGTSTALQLQRRGLDVALVDRRQPGEETSHGNAGIIERNGFLPPGFPGDAKFLLNIALGRWPGANYSLSAVLRLLPWLMAFRRHGSRTGVQRLAHAMNALEAYAIGEHRVLAEAAEALKYYRQTGTIYVYRTEAGFEATAAERHYARIFGVDYHELDELDLNELEPYLTAEGCRGIFWPESESVSNPGAVTKAFARSLAEKGGEILTGDARRLTRSHGGWAIATDKGPVRGRAVALCLGPWSMDILKGFGYRFPLAVKRGYHQHYKARAGAGLSRPVVDAEMGYVLAPMEKGIRLTTGIELAERDAAPTPVQVERAFRKAREIFPLTVPAEPGAWMGSRPCFPDSLPVLGAAPGESGLWLNFGHGHCGFTLGPVTGHILADLITGVPPVIDPAPLSPLRFL

SEQ ID NO: 783 - DNA, 1137 bp, Unknown
  Obtained from environmental sample
tcggcacgaggcaggctggatccagtggatgccagcatggtggtcgaggctggctgcacgctggccggggtgcgggcagccgcagcggcggcgggcctgttttatccggtcagcctggcctccgaaggcacggctacgataggcggtactctggccaccaacgccggcggcaatctcaccattcgctacggcaatacccgcgagcaggtgctgggcctggaggtggtgctggccgacgggcggatatggtccgatctcgatcccttgcgcaaggacaacagcggttatgacttaaagcagctgttcattggcagcgaaggcaccctgggtatcatcaccgccgccacgctgaagctggcgcccgcaccgcgtcagagcctgacggccatgctggcttgccctgatttgcccacgaccatggtcctgttgaagcacctgcgggcgggtctgggtgagtgtttatcagcctgcgagttcatgccgcgccttgcgctggggtttgtgctggccgatcagccaatcctgcgcgatccttgcgaacgcccgcatccctggtatgtgctggtccaggccgattccagcctgccgggtgacagcctggaggtggccgcgcacagcgttttgaaccaggcgttggagaacaatctatgccacgaggttgtcgttgccggctccaacgctcaagccgatgcgctgtgggcgctgcgcgagggcatttcggcggcgcagacgcatggcggggtcagtctcaagcatgacatctccgtgcccgtggcccgcattcccgaattcgtcgtcgaaaccgtgtcgttgctggaacaggccgtgccgggtatccgcccctgcattttcggccatctcggcgacggcaacctgcatttcaacctgagtcagccggaggacatggctgccgaggccttccgcgctctggagccggcttgcaaccgcattgtttttgatcaggtcaggcgctatcgcggctccattgcagccgaacacggcatcggccaactgcgccgcgacgaactggctgcgggtcagccgctgaaagtggcgttgatgggcaagatcaagcaggcccttgatcccaacggcttgttcaaccccggaaagcttgtgcggccttgccaacggtag

SEQ ID NO: 784 - protein, 378 aa, Unknown
  Obtained from environmental sample
  DOMAIN (122)...(372): FAD linked oxidases, C-terminal domain
  SITE (58)...(61): N-glycosylation site. Prosite id = PS00001
  SITE (65)...(68): N-glycosylation site. Prosite id = PS00001
  SITE (299)...(302): N-glycosylation site. Prosite id = PS00001
SARGRLDPVDASMVVEAGCTLAGVRAAAAAAGLFYPVSLASEGTATIGGTLATNAGGNLTIRYGNTREQVLGLEVVLADGRIWSDLDPLRKDNSGYDLKQLFIGSEGTLGIITAATLKLAPAPRQSLTAMLACPDLPTTMVLLKHLRAGLGECLSACEFMPRLALGFVLADQPILRDPCERPHPWYVLVQADSSLPGDSLEVAAHSVLNQALENNLCHEVVVAGSNAQADALWALREGISAAQTHGGVSLKHDISVPVARIPEFVVETVSLLEQAVPGIRPCIFGHLGDGNLHFNLSQPEDMAAEAFRALEPACNRIVFDQVRRYRGSIAAEHGIGQLRRDELAAGQPLKVALMGKIKQALDPNGLFNPGKLVRPCQR

SEQ ID NO: 785 - DNA, 1251 bp, Unknown
  Obtained from environmental sample
atgcacaccattgtcatcggtgccggggtggtcggcaccagcacagcgctgagcctggccgagcgagggctgtctgtcaccgttgtggaccgccataccgaggccgctgccgaaaccagccatgccaacggtggtggcatcacccccggccatgccgaaccctggaacgcgcccggcatcatccggcgcctgctgacccgttccggtgccggcgagccgtttcgcattcatgcccatgccttgccaggcctgatcggctgggggtttgattttttgtggcagtcgaaggcgtcgcgctattaccgcaatgcgaaagccaacacccggctggcggtgtattccggccagtgcctgaaacgcctgcgcgagcgtcatcagctgagctatcaccagtacacggacggctcgctggagctgtatttcagtcgctcggagctggatcatgccctggatctgcggcgcaagatcaacgatcccggcgttcagatccgggtcatcaatgtcgacgaagtgctggccatggagccggcgctggagccggtagccgggcgcatggccggcgcgatgctgctgccgcttcacgaatccggcgatgcctgcgtcttttcagccgagatgctgcgttgcgctgaatccctgggcgcgaacatccggcttggggccaatgttcagcgcatcgaacagcaacacggccgggtgataggcgttcgcttggcagacgggcatctactcgaagccgatgccgtcatcgtggctgcgggctgtggctcgccggccctggtcaaaccgctgggcttgcgcctgccgatctatccggtcaagggctactcggccacgttggagctcgagcgggccaaactcgcaccgatcatcccgctgctggacctggaacatcgcatcgtcaccgcccgctttggtaatcgcttgcggatggccggcctggccgactttgacggccacaatcgcgatgttcggtcagaccggctggaactactgctggagtccgcctgtgccctgctgccgcgtctggccgacgaaatccgctccggccgtgccgaagcctggaccggcctgcgcccgatgacgcccaagggccccccactgatcggacccacccgacttccggggttgttcctcaataccggccacggctccatgggctggacccaggcggccggatcggccgagctgatggctgatttgttgaccggacaggccccagcgatcgagcttgccccctactgttgctga

SEQ ID NO: 786 - protein, 416 aa, Unknown
  Obtained from environmental sample
  SIGNAL (1)...(20)
  DOMAIN (2)...(401): FAD dependent oxidoreductase
MHTIVIGAGVVGTSTALSLAERGLSVTVVDRHTEAAAETSHANGGGITPGHAEPWNAPGIIRRLLTRSGAGEPFRIHAHALPGLIGWGFDFLWQSKASRYYRNAKANTRLAVYSGQCLKRLRERHQLSYHQYTDGSLELYFSRSELDHALDLRRKINDPGVQIRVINVDEVLAMEPALEPVAGRMAGAMLLPLHESGDACVFSAEMLRCAESLGANIRLGANVQRIEQQHGRVIGVRLADGHLLEADAVIVAAGCGSPALVKPLGLRLPIYPVKGYSATLELERAKLAPIIPLLDLEHRIVTARFGNRLRMAGLADFDGHNRDVRSDRLELLLESACALLPRLADEIRSGRAEAWTGLRPMTPKGPPLIGPTRLPGLFLNTGHGSMGWTQAAGSAELMADLLTGQAPAIELAPYCC

SEQ ID NO: 787 - DNA, 1251 bp, Unknown
  Obtained from environmental sample
atgcatgccattgtcatcggtgccggcgtggtcggtgccagcacggcgctgagcttggccgaacgcggctttcaggtcaccgtcctggaccgtcacgctgaagctgccgccgaaaccagccatgccaacggtggcgggatcactccgggccacgccgagccctggaatgccccgggcatcatccggcgcttgttgacgcgctccggtgccggcgaggcgtttcgcattcatgcccacgccctgccggggttgattggctggggtctcggttttctttggcagtcgaaggcaacccggtactacgtcaatgccaagaataacacccggctggcagtgtattccggccaatgcctgaaacgcctgcgcgagcgtcatgagctgagctaccaccagtacacggaaggatcgctggagctgtatttcagccaatcggagctggatcacgcgctggacctgcgtcgcaacatcggtgatcccggcgtcgagatccgggtcattgatgtcgacgaagttctggccatggaacctgcgcttgagccagtggcgagacgcatggtcggagccatgctgctgccgctgcacgaatccggcgatgcccgcgttttttcagcagagatgctgcgctgtgccaagcagctgggggccaatattcgcctgggtgtcgatgtcgagcgcatcgaacagcatcagggccgggtgattggcgttcgcctccaggacggtcagctgctcgaagccgatgcggtggtcgtggctgccggctgcggctcgccggtcctggtcaaaccgctgggtctgcgtctgccgatctatccggtcaagggctattcggcgacgctggagctggagcaggccgatctggcaccgaccattccgctgctggacctggaacaccgcatcgtcactgcccgctttggcagtcgcctgcgcatggccggcctggccgactttgatggccacaatcgcgatatacgacccgaccgactggagctgctgctggaatctgcctgtgccctgctgccccgcctggccgatgaaatccggtccggccgcgccgaagcctggactggcctgcgcccgatgacgcccaagggtccgcccttgatcgggcccacccgcattccgggcttgttcctgaacaccggccacggctccatgggctggacccaggcggccggctcggccgaagtgctggccgatctggcggcaaagaaaaccccggccatcgatatggcgccctatcgcccctga

SEQ ID NO: 788 - protein, 416 aa, Unknown
  Obtained from environmental sample
  DOMAIN (2)...(401): FAD dependent oxidoreductase
  SITE (107)...(110): N-glycosylation site. Prosite id = PS00001
MHAIVIGAGVVGASTALSLAERGFQVTVLDRHAEAAAETSHANGGGITPGHAEPWNAPGIIRRLLTRSGAGEAFRIHAHALPGLIGWGLGFLWQSKATRYYVNAKNNTRLAVYSGQCLKRLRERHELSYHQYTEGSLELYFSQSELDHALDLRRNIGDPGVEIRVIDVDEVLAMEPALEPVARRMVGAMLLPLHESGDARVFSAEMLRCAKQLGANIRLGVDVERIEQHQGRVIGVRLQDGQLLEADAVVVAAGCGSPVLVKPLGLRLPIYPVKGYSATLELEQADLAPTIPLLDLEHRIVTARFGSRLRMAGLADFDGHNRDIRPDRLELLLESACALLPRLADEIRSGRAEAWTGLRPMTPKGPPLIGPTRIPGLFLNTGHGSMGWTQAAGSAEVLADLAAKKTPAIDMAPYRP

SEQ ID NO: 789 - DNA, 1248 bp, Unknown
  Obtained from environmental sample
gtgaaagaggtcgttgttctcggcgctgggatggtcggcacagcaacggctctcgcgctgcaggaacgaggatatgacgtcaagttgctcgaccgcaggtccccggggcgcgagaccagctacgggaacgccggcgttatccagggcgaagcgcacgagccgtatgctatgccacgggacatcagaacgctcgctcgtatcgctctcagaaaagacaacaatgtgaattgggacgcgcgcggactgtggcgtgccgcgccttcgctcctatcgtactggcaccattcggcgcccacgagacatcggaaggtcagcagcgaatacgcacagcttattcggcgtgcgacgcgtgaccacgcgaaatggatggcagcgtccgggtcggagacactgatccgccgcgacggctatcgtgtggctttccgcgacgatgaatcatttgaagctcagctgcgcaatgcggtgcgattgcgcggcctgtacggcgcgaccttcgacagcgaagactccgaggcgctggcggccgccgagccggcactgcgccaacgcctggctggcgcgatacgatggcgagatgcttggacctgcagcgatcctggcgctcttgttcaagcttattcggagctattcgtgagccagggcggtgagttgctcgagcgtgacatccttggactggaggaggattcatacgggtggcggttgcatacggccgtcgggacaatcgacacatcgcaagttgtcgtggcactcggcccctggtcgcccaacctcctggcatcgctaggatacaagatacgcatggtcccgaaacggggttaccacctgacctaccgatatccggcggagggcggtcctcgcctcaacctgccgcttctcgatgcttcgctaggcgccatatacgcgcccatgcgcgccggccttcgtgttgcgacggctgcggatttggcgtcctttcgcgcaggcgtcatgccgaggcaaatgcagcgcgccgagctggctgctcgcgagctgttcgacatcggcccatcgaacgaaacgtcggtatggatgggcgttcgcccttgcatgcccgatatgatgccggttgtcggagccgcaccccatcatcgcgggctctggttcaactttgggcacggtcatcaaggattcacactgggcccgacaaccggagagttactcgccgaagcaatggacctcgaaacagccggatcaattccgccaatcgcggcctcgcggacgtttcgttag

SEQ ID NO: 790 - protein, 415 aa, Unknown
  Obtained from environmental sample
  SIGNAL (1)...(19)
  DOMAIN (3)...(396): FAD dependent oxidoreductase
  SITE (349)...(352): N-glycosylation site. Prosite id = PS00001
MKEVVVLGAGMVGTATALALQERGYDVKLLDRRSPGRETSYGNAGVIQGEAHEPYAMPRDIRTLARIALRKDNNVNWDARGLWRAAPSLLSYWHHSAPTRHRKVSSEYAQLIRRATRDHAKWMAASGSETLIRRDGYRVAFRDDESFEAQLRNAVRLRGLYGATFDSEDSEALAAAEPALRQRLAGAIRWRDAWTCSDPGALVQAYSELFVSQGGELLERDILGLEEDSYGWRLHTAVGTIDTSQVVVALGPWSPNLLASLGYKIRMVPKRGYHLTYRYPAEGGPRLNLPLLDASLGAIYAPMRAGLRVATAADLASFRAGVMPRQMQRAELAARELFDIGPSNETSVWMGVRPCMPDMMPVVGAAPHHRGLWFNFGHGHQGFTLGPTTGELLAEAMDLETAGSIPPIAASRTFR

SEQ ID NO: 791 - DNA, 1044 bp, Unknown
  Obtained from environmental sample
atggatacagtgaaagttgttttgtggggcatcggtgccatgggttcagggatgtatcaccttctgcagaaaaagcaaggtgtccacattgccagtgccatcgggagaaatcccgggaagctgggaagagatctcggagaggctttgggcacggagccctgcggtgttcgtgtttcagaagatgctgaaaaagtcctgaatcaaaacgcgccttcagtggttctccatgccacaggctcctttttgaaggacgtttacgaagaactcgtcctggccatcaggtcgggggctcatgtcatcaccatcgccgaagagatggcggaaccctgggcagcggactctcggctggccgatcaactgaaccaagaggcgaaggaaaggggcgttaccgtcatcgggacgggaatcaatccaggttttgttcttgacgctctcatcatagccatgtcaggggtttcccttcacatcaacaaaattgaagcggaacgcattaacgaccttgctcccttcggctcctccgtgatggcttcccagggcgtgggcgtcacccccgaggcctttgagaggggcgttcaaaacggaaccattgtggggcatattgggtttaaacagtccatcagcctcattgcaagggccttcgactgggagttggaccgcattgtggaggaaaaggaacccatcatctccacaacacggcgggaaacaccttatgtcatcgtggaaccgggcatggtagccggatgccgtcaccatgcctacggttatgtgaaggacttggaagtcatcagcctgaaacacccccaacaggtgcgtcctgaaatggaagaggtggaaacaggcgatttcatcaagcttcacggcgaacccacccttaacatcgccatcaagcccgaaattccaggaggcaaaggaacgacagccaaggcggtcaacatgatccccgttgttttgaaaagcagccctgggttgaaaacactgctggacgttttaacccccatctggtggaacaccctcagaaaaggtgaccacaccattggctcttga

SEQ ID NO: 792 - protein, 347 aa, Unknown
  Obtained from environmental sample
  DOMAIN (4)...(106): Dihydrodipicolinate reductase, N-terminus
  SITE (195)...(198): N-glycosylation site. Prosite id = PS00001
MDTVKVVLWGIGAMGSGMYHLLQKKQGVHIASAIGRNPGKLGRDLGEALGTEPCGVRVSEDAEKVLNQNAPSVVLHATGSFLKDVYEELVLAIRSGAHVITIAEEMAEPWAADSRLADQLNQEAKERGVTVIGTGINPGFVLDALIIAMSGVSLHINKIEAERINDLAPFGSSVMASQGVGVTPEAFERGVQNGTIVGHIGFKQSISLIARAFDWELDRIVEEKEPIISTTRRETPYVIVEPGMVAGCRHHAYGYVKDLEVISLKHPQQVRPEMEEVETGDFIKLHGEPTLNIAIKPEIPGGKGTTAKAVNMIPVVLKSSPGLKTLLDVLTPIWWNTLRKGDHTIGS

SEQ ID NO: 793 - DNA, 1233 bp, Unknown
  Obtained from environmental sample
gtgaaagtcgatgcggtcgtcctgggcgccggcatggtcggcatcccggttgcgttgcacctgcaggcgcgcgggcgctcggtggtgctggtggaccggcgcggcgcggccgaggaaacctcctacggcaacgcgggcctgatccagcgcgagggcgtctatccctacggcttcccgcacgacttcggcgcgctgctgcgctacggcttcaaccggaccatcgacgcgcactaccacccgtcggcgctgctcgacctggcgcctttcctgtggaagtactggcaccactcgcgcccggcgcgccacgccgagatcgcgcgcctgtacgccaggctgatcgagcactgcgtgaccgagcacgacgcgctggcgcaggaagccggcgccacggacctcatcaagcgcaagggctggatgcgcgtcatccgcaccgagcggcagcgcgacaagctgttcgcggaggcggagcagtggcgcagggaattcggggtgaatttttccgccttgaacaaaaaagaattgcaggaaaaagagccgcaccttgcgccggtgctcgtcggagcgctgcattggacggatccgacgagcgtcgtcgacccgcaggggctcgcgctggcgtatttgaagctgttcgaaagcaggggaggcaagttcgttcagggaaacgcgctttcgctcgaagccggctggaaggtgcaaaccgtcgaaggtcccgtgcaggcggaccatgtggtggtcgcgctcgggccgtgggcggacctggtcacgaggaagttcggctacgacctgccgctcgcggtgaagcgcggctaccacatgcactaccgcgcggcgggcaaggcgatgctgaaccacccgatcctggacaccgagcgcggctacctgctcgcgcccatgcggcgcggcatccgcctcacgacgggcgcggaattcgcgcggcgcgacgcgatccgcacgccggtgcagctcgggcgcgccgagccgattgcgcgcgacctcttcccgctggccgagcgcgtggacacggaagcctggatgggcgcgcgcccgtgcacgccggacatgatgcccatcatcggccccgcgccgcggcacacgggcctgtggttcgcgttcggccacgcgcaccacggcctcacgctcgggccggtgaccggccgcctgatcggtgagatgatcgccggcgagaagccgttcgtggatccgcatccctaccgggccgaccgcttctag

SEQ ID NO: 794 - protein, 410 aa, Unknown
  Obtained from environmental sample
  DOMAIN (4)...(392): FAD dependent oxidoreductase
  SITE (72)...(75): N-glycosylation site. Prosite id = PS00001
  SITE (167)...(170): N-glycosylation site. Prosite id = PS00001
MKVDAVVLGAGMVGIPVALHLQARGRSVVLVDRRGAAEETSYGNAGLIQREGVYPYGFPHDFGALLRYGFNRTIDAHYHPSALLDLAPFLWKYWHHSRPARHAEIARLYARLIEHCVTEHDALAQEAGATDLIKRKGWMRVIRTERQRDKLFAEAEQWRREFGVNFSALNKKELQEKEPHLAPVLVGALHWTDPTSVVDPQGLALAYLKLFESRGGKFVQGNALSLEAGWKVQTVEGPVQADHVVVALGPWADLVTRKFGYDLPLAVKRGYHMHYRAAGKAMLNHPILDTERGYLLAPMRRGIRLTTGAEFARRDAIRTPVQLGRAEPIARDLFPLAERVDTEAWMGARPCTPDMMPIIGPAPRHTGLWFAFGHAHHGLTLGPVTGRLIGEMIAGEKPFVDPHPYRADRF

SEQ ID NO: 795 - DNA, 2310 bp, Unknown
  Obtained from environmental sample
atgaatgcggtcacccgcgaaacgacccttgatgacaaatacgtcttgttgcgtggcaaagtttacctcagcggcatccaggcgctggtcaggcttccacttgacattgtccggcgcgaccgttcggcagggctgacgacggcggcatatgtttcgggctatcgcggctcgccgctggccgggtacgatcagcaacttgtcaaggcaaagcgcttcctcgatgaacacggtgtcgtattccagccgggcgtcaacgaggaattggccgcgaccgccgtctggggcacccagaaggtcggattgcatgggccatcggactacgatggcgtggccggcatctggtacggcaaggcccccggggtcgaccgcacgctggacgtgtttcggcacgccaatgccagcggcaccgccggggcaggcggcgtgctagcgctggccggcgatgatcacctcgcgaaatcgtccagccttcctacccagagcgaattcgcgttcatgcacgccgagatgccggtgctaagcccgtccgatctgcaagatgtactggactacgggatgcacggcatcgcgctttcgcgcttcgccggtgtctgggtcgggcttattgcgcttgccgacacgatggattcctctggaatcgtgtgcgtcgaccccgatcgtctggccgcgcgccggccgatcgacattgccgatccgcgcacggttgccgagttgaaccagccgacgcgcctcgacacccgcctgcagaccgaagtgctgatgcgcgaattgcggctgcctgccgcgcaggcctacgtccgggcgaacgggctcgatcgccgcgaattcggcgcagaacgtgcgcgtctcggcatcatcgcgtctggcaaggcgtaccgtgatctgcgccagacgctggacctgatggggatcagcgaggaggccgcccgcgaccttgggctggccgtcttcaaggtagccatgccgtggccgctcgagccggaggcgatcggcgggttcgtgcgtggcctcgaccgggtcctcatcgtggagaacaagcggcccgtcatcgagccgcagctcaaggacatgctctaccactggccagcgaccttgcggcccgaattgtggggaaagcaccggccggatggtcgcgatctgctccccgagattcgcgagtgcgctcccgattccatcgccccggcgctgctggctttcctgccgaaatccgagcaatccccggaaatgcgggcggcagcggagcgaatcgcggcgcgcattgactgggcccaggatcacgcagccgattccagtcgtagtgcctatttctgctccggttgcccgcacaacacctcgaccctgacgccggaaggcagccgcagccagccaggcattggctgccatgccatgaccgagacagcacagcgcaccaccgatggcttggtcgccatgggcggggagggggtgccttggatcggacagcaccatttttccaaggacggccacgccttcgcgaatctcggcgacggcacctattatcattccggcatactggccatccgtgccgccgtcgccgccaaggcgccgatcacctacaagctcctctacaacgacgccgtggccatgaccggcggtcaaccgatggacgggccgctcgacgtgccgcagcttgtcgcccagcttcacgccgaaggcgtcggtcggatcgtgctggtttcggagcggccggaggcctatcgcaaggcgacgctgccggccggcgtgccggtgcgccaccgcgacgacctcatggaggtgcagcgcgagctccaggcgtatcggggcgtatcggtcatcgtttacgaccagacctgcgccgcggagaagcgccgtcggcgcaagaagggcagctatgaggatctccccacgcgcctgttcatcaaccctcgagtctgcgagaactgcggggactgctcggtgcagtccaactgcatctccgtcgagccgatagagaccgctttcgggcgcaagcggcggatcaaccagtcgagctgcaacaaggactattcctgcgccaagggcttctgcccctccttcgtcgtggtcgacggcgccaggctcgccacggcggccaatcacggcttcgacgtcgaggcgctggccgccgaactccccgtcccgcagatgcacctcggcgaccggccgaccaatctgctgttcacgggcatcggcggcatgggggtgacgacaacggcggcggtgctggcaatggccgcccatctcgacgggctcgcggcggccacgctcgacatgaccggtcttgcccagaagaacgggccggtcctcgtgccg

SEQ ID NO: 796 - protein, 770 aa, Unknown
  Obtained from environmental sample
  DOMAIN (457)...(607): Thiamine pyrophosphate enzyme, C-terminal TPP binding domain
  SITE (134)...(137): N-glycosylation site. Prosite id = PS00001
  SITE (449)...(452): N-glycosylation site. Prosite id = PS00001
  SITE (677)...(680): N-glycosylation site. Prosite id = PS00001
MNAVTRETTLDDKYVLLRGKVYLSGIQALVRLPLDIVRRDRSAGLTTAAYVSGYRGSPLAGYDQQLVKAKRFLDEHGVVFQPGVNEELAATAVWGTQKVGLHGPSDYDGVAGIWYGKAPGVDRTLDVFRHANASGTAGAGGVLALAGDDHLAKSSSLPTQSEFAFMHAEMPVLSPSDLQDVLDYGMHGIALSRFAGVWVGLIALADTMDSSGIVCVDPDRLAARRPIDIADPRTVAELNQPTRLDTRLQTEVLMRELRLPAAQAYVRANGLDRREFGAERARLGIIASGKAYRDLRQTLDLMGISEEAARDLGLAVFKVAMPWPLEPEAIGGFVRGLDRVLIVENKRPVIEPQLKDMLYHWPATLRPELWGKHRPDGRDLLPEIRECAPDSIAPALLAFLPKSEQSPEMRAAAERIAARIDWAQDHAADSSRSAYFCSGCPHNTSTLTPEGSRSQPGIGCHAMTETAQRTTDGLVAMGGEGVPWIGQHHFSKDGHAFANLGDGTYYHSGILAIRAAVAAKAPITYKLLYNDAVAMTGGQPMDGPLDVPQLVAQLHAEGVGRIVLVSERPEAYRKATLPAGVPVRHRDDLMEVQRELQAYRGVSVIVYDQTCAAEKRRRRKKGSYEDLPTRLFINPRVCENCGDCSVQSNCISVEPIETAFGRKRRINQSSCNKDYSCAKGFCPSFVVVDGARLATAANHGFDVEALAAELPVPQMHLGDRPTNLLFTGIGGMGVTTTAAVLAMAAHLDGLAAATLDMTGLAQKNGPVLVP

SEQ ID NO: 797 - DNA, 1437 bp, Unknown
  Obtained from environmental sample
atgacaacgcaagcagccgaagaggtcatcgcccgattgtccgggctgctgggaacggcggccgtgctcggcccggacgatgacatcgcgcgttatgtcaacgagccgcgtggtcgctaccacgaccggccgctggcggtggtgcgtccggcttccacccagcaggtggcggcgaccgtggcgctgtgtcgcgaggcgggcatcgcggtggtggcgcagggcggtaataccggcctggtcggtggcgcctcggtcaccggcagcggtcgcgagatcctgctttcgctcgagcggctgcgcgctatccgccaggtcgatgccgagggggccaccctcatcgtcgaggcgggttgtccgctcgcgcgtgtgcaggaagcggctgccagtgccgggctgctgttccccttgagcctggcttctgccggcaccgccaccattggtggcaacattgccaccaatgccggcggccatctcaccgtgcgccacggcaatacccggcgccaggtgctgggcctggaggtggtgcttgccgatggccgcatctacaacgggctgtcggctctgcgcaaggacaacagcggctacgatctgaaccagttgttcatcggttcggagggtactctcggcatcatcacggctgcgtcactggctctggcgccggcctcgcgccagagcctgaccgccctggtcggactcgattccctgcccgaggtgctggccctgctcaaactcatgcgttcccgcctgggcgagaccctctcggccttcgagatgatgccgcgcctggccatggaattcgtgctcgaataccttgatgtacatgaccctctcggccaccgccacgactggtacgtgttcgttcaggccgacagcgccgtgaccgggagctggctgcgcgagacctgcgtcgaggcgctggaggcggctgccagcgaagggctagcgcgcgacgtggtcgtggccggcaacgatgcccaggccgatgcactgtggcgcctgcgcgaatcggtatcaccggcgcagaagttgggtggcgtcagcctcaagcatgacatctcggttccggtggccgccatcccggctttcatggaagacaccgttgccgcgctcgaagcgctcgtgcccggcattcggccgtgcgtgttcggtcatgtcggcgacggcaacctgcatttcaatcttgcccagccgatggccatgggcgccgaggcctttcgagcccgcgaggacgagtgcaaccgcattgtcttcgaccgtgttgtgcgccacggtggttcgattgcggccgagcacggcatcggtcgcctgcgctcggccgagctggcccggtgtgccgacccggtgcgcctggacctgctgcgtcgcctcaagcactgtctggatcccgaggggctgctcaaccccggcaaagtggtggagaaatcaagcaatgactga

SEQ ID NO: 798 - protein, 478 aa, Unknown
  Obtained from environmental sample
  DOMAIN (44)...(185): FAD binding domain
  DOMAIN (221)...(471): FAD linked oxidases, C-terminal domain
MTTQAAEEVIARLSGLLGTAAVLGPDDDIARYVNEPRGRYHDRPLAVVRPASTQQVAATVALCREAGIAVVAQGGNTGLVGGASVTGSGREILLSLERLRAIRQVDAEGATLIVEAGCPLARVQEAAASAGLLFPLSLASAGTATIGGNIATNAGGHLTVRHGNTRRQVLGLEVVLADGRIYNGLSALRKDNSGYDLNQLFIGSEGTLGIITAASLALAPASRQSLTALVGLDSLPEVLALLKLMRSRLGETLSAFEMMPRLAMEFVLEYLDVHDPLGHRHDWYVFVQADSAVTGSWLRETCVEALEAAASEGLARDVVVAGNDAQADALWRLRESVSPAQKLGGVSLKHDISVPVAAIPAFMEDTVAALEALVPGIRPCVFGHVGDGNLHFNLAQPMAMGAEAFRAREDECNRIVFDRVVRHGGSIAAEHGIGRLRSAELARCADPVRLDLLRRLKHCLDPEGLLNPGKVVEKSSND

SEQ ID NO: 799 - DNA, 1281 bp, Unknown
  Obtained from environmental sample
atgactgaagcttcccctcgacacgtgactgtcatcggcggtggcgtggttggaacgaccaccgcattggccctggccgagcgcgggctggaggtcaccctggtcgagcgctgccaccaggccgccgaggagaccagcctggccaacgggggggggctcaccccggcccatgccgagccctggaatgcacccggcctgctcggcaagctggtgcgcaatctcggccgcgcggatgcgccctatcggctatcgccgctggccgtgccgggcatgggcctgtggggactgcgctttctggccaacatgcgccgcgagcgtttcatggccaatgcgcgcagcaacattcgactggggttgtattcgctggaatgcctgcggcgctggcgtgaaagccatggcatcgagtacgaccagacgctgtcgggttccatgcaggtgtatttctcgcgcgaactgatggccgaatcggtgcagttccggcgcgagctgctcgatggcgcggccgagatcgagccggtgggtatcgacgaggcgattgcccgagaaccggccctggccccggtccggcgccgactggccggggccatcgtctttcccgatcacgaatccggtgatgcctgccgcttcagccgggcggcgctggacctggcctttgagcggggtgccaaaaccctgctcgacacggccgtccgttcgattcgagtggaccagggtcgcgtccaggccgtggtcaccgaccagggcgagatcgactgcgatgcctgcgtggttgcagccggcccggcctcggccaggctggtgcggccgctgggcttgcacctgcccatctatcccgtgcgtggctactcggccacgttcgagatcgaccgcaccgacgcgctgccgaccctgccgatgctggataccgccagccgcttcgtcacgcttcgcctgggtgagcgtggcctgcgcatcgccggcctggccgatttcgctggcccgcatcgccgcattcgcccacggcgcatcgccagcctgctggcgggcgcgcgccgcctgctgccggaactggcctcggaactggccgtggagcgcgccgaactgtgggcaggcctgcggccggtgacacccgatggggtgcccctgctcgggcccacccgcatcaccggcttgcacgtcaatgcaggccatgggcccatgggctggaccatggcctgcgggtcggccgacctggtggcggccggcctttgtggggaggaaccccgaatcgagatggatgcctacggcgtcgcgcgacgctga

SEQ ID NO: 800 - protein, 426 aa, Unknown
  Obtained from environmental sample
  DOMAIN (8)...(408): FAD dependent oxidoreductase
MTEASPRHVTVIGGGVVGTTTALALAERGLEVTLVERCHQAAEETSLANGGGLTPAHAEPWNAPGLLGKLVRNLGRADAPYRLSPLAVPGMGLWGLRFLANMRRERFMANARSNIRLGLYSLECLRRWRESHGIEYDQTLSGSMQVYFSRELMAESVQFRRELLDGAAEIEPVGIDEAIAREPALAPVRRRLAGAIVFPDHESGDACRFSRAALDLAFERGAKTLLDTAVRSIRVDQGRVQAVVTDQGEIDCDACVVAAGPASARLVRPLGLHLPIYPVRGYSATFEIDRTDALPTLPMLDTASRFVTLRLGERGLRIAGLADFAGPHRRIRPRRIASLLAGARRLLPELASELAVERAELWAGLRPVTPDGVPLLGPTRITGLHVNAGHGPMGWTMACGSADLVAAGLCGEEPRIEMDAYGVARR

SEQ ID NO: 801 - DNA, 1257 bp, Unknown
  Obtained from environmental sample
atgcatgtgatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccaggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaatacccgcctggcggtatattccggtcactgtttgaaagccctgcgcgagcgattcgagctgaactatcaccagtacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcggccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 802 - protein, 418 aa, Unknown; identical to SEQ ID NO: 734
  Obtained from environmental sample
  SIGNAL (1)...(18)
  DOMAIN (2)...(400): FAD dependent oxidoreductase

SEQ ID NO: 803 - DNA, 1257 bp, Unknown
  Obtained from environmental sample
atgccaccgcatgtgatcgtggtcggagccggcgtggttggcgccagcacggcgctgagcctggccgagcgcgggctggcggtgaccgtgcttgaccgccagccgcaggctgcggccgaaaccagccatgccaacggcggcggcatcacgcctggccatgccgaaccctggaacgcgcccggcatcatccaacgcctgctgactcgttcgggcaccggcgagccgttccgcattcatgctcacgctttgccgggcctggtcagctggggtctcaattttctgtggcagtcgaaggcgtcgcgctattaccgcaatgccaagaacaatacccgcctggcggtgtattccggccagtgcctgaagcgcctgcgcgagcgtcatcagctgagctatcaccagtacacggacggctcgctcgagctttatttcagccagtccgagctggaccatgccctggacctgcgacgcaaaattgacgatcccggcgtcgagatccgggtcatcgatgccgacgaagtcgtcgccatggaaccggcgctcgagccggtggcggggcgcatggctggcgcgatgttcctgcccctgcatgagtctggcgatgcctgtgtcttttcagccgaaatgctgcgctgtgctgaatcgctgggcgcgaagatccggctgggcgccaatgttcagcgcatcgaacagcaacacggccgggttattggcgttcgcttggcagacgggcatctactcgaagccgatgccgtgatcgtggccgccggctgtggctcgccggcgctggtcaaaccgctgggcctgcgcctgccgatctatccggtcaagggctactcggcgacgctggcgctcgagcaggccgagctggcaccgaccatcccgctgctggacctggaacaccgtatcgtcaccgcccgcttcggtaatcgcctgcgcatggccggcctggccgacttcgacggctacagccgcagcattcgcactgaccggatcgagctgttgctcgaatccgcctgcgccctgctgccgcgccttgccgaagaaatccgctccggccgcgccgaagcctggactggtcttcgcccgatgacacccaagggcacagcgctgctcggacccacccgtattcccggcctctacctgaataccggccacggctccatgggctggacccaggccgccggctcagccgagatactggccgatctgttgaccgaacgggcgccggcgatcgagctggctccgttcgctctctag

SEQ ID NO: 804 - protein, 418 aa, Unknown
  Obtained from environmental sample
  DOMAIN (4)...(403): FAD dependent oxidoreductase
  SITE (109)...(112): N-glycosylation site. Prosite id = PS00001
MPPHVIVVGAGVVGASTALSLAERGLAVTVLDRQPQAAAETSHANGGGITPGHAEPWNAPGIIQRLLTRSGTGEPFRIHAHALPGLVSWGLNFLWQSKASRYYRNAKNNTRLAVYSGQCLKRLRERHQLSYHQYTDGSLELYFSQSELDHALDLRRKIDDPGVEIRVIDADEVVAMEPALEPVAGRMAGAMFLPLHESGDACVFSAEMLRCAESLGAKIRLGANVQRIEQQHGRVIGVRLADGHLLEADAVIVAAGCGSPALVKPLGLRLPIYPVKGYSATLALEQAELAPTIPLLDLEHRIVTARFGNRLRMAGLADFDGYSRSIRTDRIELLLESACALLPRLAEEIRSGRAEAWTGLRPMTPKGTALLGPTRIPGLYLNTGHGSMGWTQAAGSAEILADLLTERAPAIELAPFAL

SEQ ID NO: 805 - DNA, 1323 bp, Unknown
  Obtained from environmental sample
aaagaattcggcacgaggtgttatcgggcgcaaccgctcgcggtggcgcgcccggccagcctgaaggaaatggccgacgcggtcaggcagtgcgcgcaagccggcgtgccgatggtggcacagggtgggcataccggtctggttggaggcgcggttgctgggccgaatgaaatcgtcctgagcctggagcgcatgaatcgcgttcgcaggcttgatgagcacgatgccagcatggtggtcgaggccggttgcacattggccgaagtgcgggcaaaagctgccgcgtcgggcctgttctacccggtcagtctggcctcggaaggtacggccaccataggcggtaccctggccaccaatgccggcggcaatctcaccatccgctatggcaatacccgggagcaggtgctgggccttgaggtggtgctggccgacggtcaggtctggtcggaccttgatcctttgcgcaaggacaacagcggctacgatcttaaacaagtgttcatcggcagcgaaggcaccctgggcatcatcacggcggccacgctgaagctggcgcccgcgccgcgccagagcctgacggcgatgctggcctgtgctgatctgcccacggccatggccctgctcaagcatctgcgcgcgggcctgggcgagtgtctgtcggcctgcgagttcatgccgcgcctggcgatggagttcgtgctgctggaccagccggcgcagcgggatcctttcgattcaccgcatccctggtacgtgctggtccaggcggactccagcctgccgggagacagcctggagcaggctgctcacagcgttttgcaccaggcattggagagcggactctgccgcgaccttgtggtggctgtcagcgaggcacaagtcagggccttatggtccttgcgcgagggtatctcggcggcccaaaagcatggcggagccagcatcaagcacgacatcgccgtgcccgtggccagcattcccgagttcgtggctgaaacggtcgcggcgctggaacggcgcgtgacaggcattcgcccctgcatcttcggccatctcggcgacggcaatctgcatttcaacctcagccagccggcgcacatggacgcggagcggttccgcgccctggagcctgactgcaatcgcatggtgtttgaccaggtcaggcgctaccgcggctccatcgccgccgaacacgggatcggtcaactgcgctgcgaggagctggcccgtggtcaagcggacaaggtcgagctgatgcgccgggtcaagcaggctctggatcccgatggactattgaatccgggcaaggtcttgcggccgtag

SEQ ID NO: 806 - protein, 440 aa, Unknown
  Obtained from environmental sample
  DOMAIN (12)...(151): FAD binding domain
  DOMAIN (187)...(437): FAD linked oxidases, C-terminal domain
  SITE (124)...(127): N-glycosylation site. Prosite id = PS00001
  SITE (131)...(134): N-glycosylation site. Prosite id = PS00001
  SITE (365)...(368): N-glycosylation site. Prosite id = PS00001
KEFGTRCYRAQPLAVARPASLKEMADAVRQCAQAGVPMVAQGGHTGLVGGAVAGPNEIVLSLERMNRVRRLDEHDASMVVEAGCTLAEVRAKAAASGLFYPVSLASEGTATIGGTLATNAGGNLTIRYGNTREQVLGLEVVLADGQVWSDLDPLRKDNSGYDLKQVFIGSEGTLGIITAATLKLAPAPRQSLTAMLACADLPTAMALLKHLRAGLGECLSACEFMPRLAMEFVLLDQPAQRDPFDSPHPWYVLVQADSSLPGDSLEQAAHSVLHQALESGLCRDLVVAVSEAQVRALWSLREGISAAQKHGGASIKHDIAVPVASIPEFVAETVAALERRVTGIRPCIFGHLGDGNLHFNLSQPAHMDAERFRALEPDCNRMVFDQVRRYRGSIAAEHGIGQLRCEELARGQADKVELMRRVKQALDPDGLLNPGKVLRP

SEQ ID NO: 807 - DNA, 1329 bp, Unknown
  Obtained from environmental sample
atgcatatcgtcgtaatcggcgcaggggtgatgggtgtgaccacggcttatgctttgagtcagcgtggtcacagggttacggttatcgagcagttatccagtgccgggcaggagaccagccgggccaatgccgggcagcgcagctatggctatgtttatccctggtcctctccggcgatgatcaaaaaggcgctgccctggctgttgcagaaggatggcccattgaagatgcagatgccgccgagccttgacgcactgcgctttctgtttgccacctggcgttatgcaaaaccgggtatcttcgaggccaacaaacgcgccatgctgcaactcgccgcctacagtcgtgagtgcttccataccctggaggctgaactgtcacttgcgtttgatggtgagcagggtggggtgatggagctggccagcgatgcggccagcgcagcgagtcttcagtcagccttgccgttgctgcgcgaagtcggcgtgccgcatcgcttcctgaacgcggaggaaaccctggcgcaggaaccggccttgtcggggcacggtcctttgctgggtgcgctgtggttgccggaggatggcaccggcgactgctgccacttcagtcaggcgctggcggctgcctgtgagtctcggggtgttgagtttcgctacaacacgcgggtggtttcggcagagctggagcgtgagcaggtggtcggattgctgctcaggcctgctgatgaggatcaggtatattcagggccaaagtcaaaacaggagtcagaacccggctctgaacaggcgccagaactgttgcaggcggatgcctatgtgctttgcgccggaaccgagtccaaccgtctggggcaactgtttggcagtcggctgatgatctacccggtcaagggctactccctgaccgccccgctgctcgaccctgataaagcgccgcgctactcggtgatcgatgatcgcttcaaggtggtcacgacacggctgggttcgcggatgcgcgcgaccggctttgtcgagctgaccggtatgaatcgcgagatacccgaggcgcgtcttgatacgattcgccgcgccgtggcgtcgcgttttccgggggcagcggatatgagtcaggctgagccctgggcaggatttcgacccatgacgccggatggcccgccgctgatcggtcgtggccagtatcacaacctctatctgaacaccgggcatggcacctttggctggacactgtcggcggcgagtgcacaggtgattgcacaactggtggatggtgaggcgccggcagtagcgctggacgctttccgaccggaccggttcgaaccgacctga

SEQ ID NO: 808 - protein, 442 aa, Unknown
  Obtained from environmental sample
  SIGNAL (1)...(18)
  DOMAIN (2)...(421): FAD dependent oxidoreductase
MHIVVIGAGVMGVTTAYALSQRGHRVTVIEQLSSAGQETSRANAGQRSYGYVYPWSSPAMIKKALPWLLQKDGPLKMQMPPSLDALRFLFATWRYAKPGIFEANKRAMLQLAAYSRECFHTLEAELSLAFDGEQGGVMELASDAASAASLQSALPLLREVGVPHRFLNAEETLAQEPALSGHGPLLGALWLPEDGTGDCCHFSQALAAACESRGVEFRYNTRVVSAELEREQVVGLLLRPADEDQVYSGPKSKQESEPGSEQAPELLQADAYVLCAGTESNRLGQLFGSRLMIYPVKGYSLTAPLLDPDKAPRYSVIDDRFKVVTTRLGSRMRATGFVELTGMNREIPEARLDTIRRAVASRFPGAADMSQAEPWAGFRPMTPDGPPLIGRGQYHNLYLNTGHGTFGWTLSAASAQVIAQLVDGEAPAVALDAFRPDRFEPT

SEQ ID NO: 809 - DNA, 1242 bp, Unknown
  Obtained from environmental sample
atggatttcgatgtaatcgtgttgggcgccgggatcgtcggcgtgtcgtcggcgctgcatctgcaggatcgtggccgccgcgtggcgctcgtcgatcggcgcggccctggtgaagagaccagtttcggcaatgcaggtctgatcgagcgctcgtcggtggtcccttacgcgtttccgcgcgatttcggaacactgctgcgctacatgcgcaatcgttcgatcgacctgtactgggactataaggccgtgccgtcttttgccgcgtggctcgcgcgattctggcgggagtcgtcgccggagcgcttggaagcggccgcgcgcgacatgctgccgttgatccgccagagcgtcgacgaacacgatgtgctgatcgagcgtgccggtcttcagagactcgcgcatgacggcggctggatcgaggcatttcgcacgcgctccgaatatgaacggcaggcatcagccgccgaagtcaccgcgagtcggtatgggttgcgcgtggcggcgctcgatgccgcgcggctgctggcgcgcgagcctgggttgggcagcggtttctgtggcgccctgcattggcaggacccgaagagtatttccaacccaggcgcgttgacgaagggatatgcacggttgttcgaggacggcggcggaacgttgctgaccggagaggcaagtacggtgcgtcaggaggccgatgcgtggactgtgcagacgtcccaaggcaggatcagtgccaacgaggtggtcgtggcactcggtccgtggtccgataaagtttttgagccgcttggatatcgcataccgctgcgcgcgaagcgcggctatcacatgcactacgaggccacgaaaccactgctctcggtgccgcttgtggatacggagcgagggtacgtggtggcgccaatggaaggccgcttgcgtttgacgacgggtgttgaaatcgcccgccgggatgcaccgccgacgggtattcaacttgcgcgcgcagaaagcgtcgcccggccggttttcggtttggggcgccggctggacgacgcgccttggatcggcttgcgtccctgcacgccagacatgcggcccgtcatagggcgagcgcctcgccatcgaggactctggttcgcgtttggccacaaccaccacggattgacgatcggtcccgtgacgggccgtttgctggcggaaatgatgacgggcgcgacgccttgcgccgatccctatccgtttcgtcccgagcggttccggtaa

SEQ ID NO: 810 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSSALHLQDRGRRVALVDRRGPGEETSFGNAGLIERSSVVPYAFPRDFGTLLRYMRNRSIDLYWDYKAVPSFAAWLARFWRESSPERLEAAARDMLPLIRQSVDEHDVLIERAGLQRLAHDGGWIEAFRTRSEYERQASAAEVTASRYGLRVAALDAARLLAREPGLGSGFCGALHWQDPKSISNPGALTKGYARLFEDGGGTLLTGEASTVRQEADAWTVQTSQGRISANEVVVALGPWSDKVFEPLGYRIPLRAKRGYHMHYEATKPLLSVPLVDTERGYVVAPMEGRLRLTTGVEIARRDAPPTGIQLARAESVARPVFGLGRRLDDAPWIGLRPCTPDMRPVIGRAPRHRGLWFAFGHNHHGLTIGPVTGRLLAEMMTGATPCADPYPFRPERFR

SEQ ID NO: 811 - DNA, 1242 bp, Unknown; identical to SEQ ID NO: 809
  Obtained from environmental sample

SEQ ID NO: 812 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 813 - DNA, 1242 bp, Unknown; identical to SEQ ID NO: 809
  Obtained from environmental sample

SEQ ID NO: 814 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 815 - DNA, 1242 bp, Unknown; identical to SEQ ID NO: 809
  Obtained from environmental sample

SEQ ID NO: 816 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 817 - DNA, 1269 bp, Unknown
  Obtained from environmental sample
gtgaaaattctcgtcctgggcgccggtgtggtgggtacggccacggccctggctctggcccggcgcggcctggacgtgaccctgatcgagcgcgagggggagcccgcccgcggcaccagccacgccaacggcgggggcatcaccccggcccacgccgaaccctggaacgcgccgggcatcggctggatgctggtgcgctggctcggccgccgcgacgcgccgttccggctcaggccctcggcgatcccgggcatgacgcgctggggactggcctttctggccaactccaggcgcaggcgcttcatcgaaaacgcccgcgccagcatccgcctggcggtgtattcgggacaacggctgaaggcctggcgcgatgaactggagctggaatacgggcagcgcacgctgggctcgatcaaggtcttctggacccgtcgcgagctggataagtccctgaaactgctgaccggcgtcggccatccagaggtggcctggaaggcgttgtcgccggccgaggcggtggagctcgagcccgccctgggcccggttgccgaaaggctggccggcacgctgcactttcccggcaacgagtcgggcgacgcccgccggttcagcctggccgcggccgagaaggcgcgcgagctcggcacgcggttgcagttttcaaccgccgtggagtccatcgaatgcgacgcctggggtttccggagcgtgcgcacgagccagggtgatttcgaggccgaggcctgcatcgtgtgcctgggctgcgacagtccggcgctgctcaacccgctgggcgtgcgcgtgccgatctacccggtcaagggctactcggccacccttgagcttgacgatcccgccgccgcgccggctggctgcgtgctcgacgcgggccaccgggtgatcgtcacccggctgggcgagaaggtgctgcgagtggccgggaccgccgagttcgctggccacgacctggaaatcgaccgggtacgggcccgctcgatgctcgacagcgcactggcggtgtttccggcgctgggccgggaaatcgagggacgcgagcccgagttctggaccgggctgcgccccatgaccccggatgggccgccgctgctcggccgcgccggcccgcgcggggtctggctgaacaccggccacggctccatgggctggacccaggcggccggctcggccgagatcctggccgacctgatctccggaaagtcgccggccatcgacgtgtccgggctcgaagcagcgcgctggaaccagtaa

SEQ ID NO: 818 - protein, 422 aa, Unknown
  Obtained from environmental sample
  SIGNAL (1)...(18)
  DOMAIN (2)...(402): FAD dependent oxidoreductase
MKILVLGAGVVGTATALALARRGLDVTLIEREGEPARGTSHANGGGITPAHAEPWNAPGIGWMLVRWLGRRDAPFRLRPSAIPGMTRWGLAFLANSRRRRFIENARASIRLAVYSGQRLKAWRDELELEYGQRTLGSIKVFWTRRELDKSLKLLTGVGHPEVAWKALSPAEAVELEPALGPVAERLAGTLHFPGNESGDARRFSLAAAEKARELGTRLQFSTAVESIECDAWGFRSVRTSQGDFEAEACIVCLGCDSPALLNPLGVRVPIYPVKGYSATLELDDPAAAPAGCVLDAGHRVIVTRLGEKVLRVAGTAEFAGHDLEIDRVRARSMLDSALAVFPALGREIEGREPEFWTGLRPMTPDGPPLLGRAGPRGVWLNTGHGSMGWTQAAGSAEILADLISGKSPAIDVSGLEAARWNQ

SEQ ID NO: 819 - DNA, 1263 bp, Unknown
  Obtained from environmental sample
gtgcatgtagtcgttctgggtgcaggcgttgtgggcaccacaacagcgctggccttggccgaaggcgggcatcaggtcacggtcatcgaccgtcagccaggccctgcccttgaaaccagctttgccaatggcgcgcagatttccgcctgccatgcgaaaccttgggctgcgcccgacgttccgttccaggccttgaaatggatgtttcagcccgatgcgccgttgctgttccggcccatgcggtgggacccgcccttatgggcgtggggcttgcggtttttacgcaactgcacccctgagcgcgtgcgcaccaacatgggccgcgcgttacgcgtatcactgtacagccgtgatgtgctgcgcgcattacgccaacgcaccaacattcagtacaaccaagtcttaagcggaatcttgcacatctaccgcacgcgcgaggagtttgccgctgggcgcgccaatgccgccaacctggaactgctgggcttgccgcaggaaatcttaagcccaaccgattgcgtgcgctacgaaccggcattggagcatgcagccaagactgatctcgtcggcggcttgatgagccccgccgatgaaagcggcgatgcgcggttgttcaccgaagaagtcatgaaactggcccaagcaaaaggcgcggccttccggtggaacgagactgttgtgaaactggaagcctcaggtcgcaaaatcacgcgcgtcatcaccagcgccggagacataacggccgatgcgttcgtgcttgctgctggaagttacagcccgatgctggcgcgcgaccttgggctcgcgctgccgatctatccggccaagggctattccatcagcaccgagatcactgtgccgcatgcggccccgaccatcagcgtcaccgatgaaacgcgctacatggtgttttcgcgcctgggcaatgtcatgcgcgtggcgggaactgcggaacttgcgggctggaacaccaagcttgatccggtgcgtgtggcccctttggtcgcgaacgccaaagcgctgttccccacggcctcagcctacaccgacgtcaacccgtggtgcggcttgcgccccaccacgccggactcggttcccatcctgggccgcacgcggattgaaaatctgatgttgaacaccggccacggcacactgggctggacgatggccgctggctcggcgcacatcatcgccgacctgatggccggccgtacgcccgagatcgatatgaatggtttgggattagaccgctttggcgcttag

SEQ ID NO: 820 - protein, 420 aa, Unknown
  Obtained from environmental sample
  SIGNAL (1)...(20)
  DOMAIN (2)...(400): FAD dependent oxidoreductase
  SITE (226)...(229): N-glycosylation site. Prosite id = PS00001
MHVVVLGAGVVGTTTALALAEGGHQVTVIDRQPGPALETSFANGAQISACHAKPWAAPDVPFQALKWMFQPDAPLLFRPMRWDPPLWAWGLRFLRNCTPERVRTNMGRALRVSLYSRDVLRALRQRTNIQYNQVLSGILHIYRTREEFAAGRANAANLELLGLPQEILSPTDCVRYEPALEHAAKTDLVGGLMSPADESGDARLFTEEVMKLAQAKGAAFRWNETVVKLEASGRKITRVITSAGDITADAFVLAAGSYSPMLARDLGLALPIYPAKGYSISTEITVPHAAPTISVTDETRYMVFSRLGNVMRVAGTAELAGWNTKLDPVRVAPLVANAKALFPTASAYTDVNPWCGLRPTTPDSVPILGRTRIENLMLNTGHGTLGWTMAAGSAHIIADLMAGRTPEIDMNGLGLDRFGA

SEQ ID NO: 821 - DNA, 1242 bp, Unknown; identical to SEQ ID NO: 737
  Obtained from environmental sample

SEQ ID NO: 822 - protein, 413 aa, Unknown; identical to SEQ ID NO: 738
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001

SEQ ID NO: 823 - DNA, 1170 bp, Unknown
  Obtained from environmental sample
atggcgaaatatgacgtggtcatcatcggcggggcgatcgtcggcagctccgtcgcctactatctgcgcgaggaaggttttaccggctcgatcgcgctggtcgagcgtgatcctcaattctcgtattccgccacgactctctcctgcgcctcaatccgccagcagttctccattccggaaaacatccgcctgtcgcagttcacgctggggctcttccgcaggctgaaggaggagttcggcgccgacgccgacatcgcgttccgggaaaacggctacctcattctcgcgaccgaagaaggcctgccggtcctggcggccaaccatgccgcgcaggaggccgaaggcgccgacatcctgctcgaggaggccggggcgctggcgcgccgcttcccctggctgtcgacggacgggatcgccgccggggcgttcgggcgcgccggcgaaggctggttcgacgcccatgcctacctgcagcttttccgcaaggcgcttcgcacgaagaaggtcgatttcatcaacgcttctctggtcagcctggagcggcagggcgatcgtgtcgccaccgcggtgctcgacgacggccagcggctggagacggggatagtggtcaacgcggcggggccgagcgccggcaaggtctcggcgatggccggaatcgcgctgccggttgagccgcgcaagcgttcggtcttcgttttcgaggcctatgacttgttccccgacatgccgctggttgtcgatccgagcggcgtctatgtgcgcccggagggcacggtctacatcgccggcggcggggaagccgaagaaaccgacggcccggccgaccccggcgatttcgatccggactgggcgctcttcgaggagcgcatctggccagcggtcgcaacccggatccccgccttcgaggcgatcaaggcgacacgcgcctgggccggccactacgactacaacaccctcgaccagaacgccgtcatcgggcggcacccgcaagtcgggaacttcatcttcgcgaacggtttttcggggcacggcctccagcaggcgccggcggtcggccgggcgatcgccgagctcatcgtgcatggcggctaccgtacgatcgactgctcggtcttcggctacgaacgcatcgccgccagccggccctaccgcgagctcaacgtgatctag

SEQ ID NO: 824 - protein, 389 aa, Unknown
  Obtained from environmental sample
  DOMAIN (5)...(224): Pyridine nucleotide-disulphide oxidoreductase
  DOMAIN (5)...(358): FAD dependent oxidoreductase
  SITE (175)...(178): N-glycosylation site. Prosite id = PS00001
MAKYDVVIIGGAIVGSSVAYYLREEGFTGSIALVERDPQFSYSATTLSCASIRQQFSIPENIRLSQFTLGLFRRLKEEFGADADIAFRENGYLILATEEGLPVLAANHAAQEAEGADILLEEAGALARRFPWLSTDGIAAGAFGRAGEGWFDAHAYLQLFRKALRTKKVDFINASLVSLERQGDRVATAVLDDGQRLETGIVVNAAGPSAGKVSAMAGIALPVEPRKRSVFVFEAYDLFPDMPLVVDPSGVYVRPEGTVYIAGGGEAEETDGPADPGDFDPDWALFEERIWPAVATRIPAFEAIKATRAWAGHYDYNTLDQNAVIGRHPQVGNFIFANGFSGHGLQQAPAVGRAIAELIVHGGYRTIDCSVFGYERIAASRPYRELNVI

SEQ ID NO: 825 - DNA, 1146 bp, Unknown
  Obtained from environmental sample
atgatggacaaccaagttctcgacttcgccgtgatcggcgcgggcatggccggcgcctcggtggcctggcgactggcaggggcaggcgcctcggtcctggtgctggagcgggagccgcagcccggctaccacgccacgggccgctccgccgcgatgttcatggaaagctatggcaccgagcagatccgcgcgctgacgcgggccagccgcgccttctacgacgcgccgcccgaaggcttttgcgaacacgcgctgctgcagccgcgcagcgtgctctacgtgggaacggtcggccaggaggcacagctcgatgacgccctggccatgtaccgccgcgacggcctgcgcgccgagcgcatcgatgcgcgccaggcctgcgccctggtgccctgcctggatgagacgcagctcgtgggcgccgtgcatgacctggatgccatggacatcgacgtggccgggctgcaccagggattcctgcgcggcatggcgcgcgccggcgcccgcctgcgctgcgctgccgaactggcgggcgccgaacgcgatggccagggcctgtggacactgacgctgcacgacggcacccgggtgcgcgcgcgcgccgtggtcaatgccgcgggcgcctgggccgatgccgtggcacggctgtgcggtgcccaggccctgggcatcgagccccggcgccgctcggccttcaccttcgccgcgcccgaaggcgaggccatccatgactggcccgcggtggtcggcgtggacgagagcttctacttcaagcccgacgcgggccagctgctgggctcgcccgccaacgccgatcccgtggcgccgcacgacgtggtggccgaggagctggacgtggccatcggcatagaccgcatcgagtccctgacccgcctgcgcatccgccggccgcgccatgtctgggcggggctgcgcagcttcgcgcccgacgacgacttcgtcatcggctgggatgtgcggcgcgagggcttcttctggctggccgggcagggcggctacggcatacagacggcggctggcgcctcggccgcggccaccgcgctgctgatgcacgagtcgctgcctggcgaactgctggcccagggcgtcgatgccgcgcggctgagcccggcgcgcttctcggcctga

SEQ ID NO: 826 - protein, 381 aa, Unknown
  Obtained from environmental sample
  DOMAIN (8)...(354): FAD dependent oxidoreductase
MMDNQVLDFAVIGAGMAGASVAWRLAGAGASVLVLEREPQPGYHATGRSAAMFMESYGTEQIRALTRASRAFYDAPPEGFCEHALLQPRSVLYVGTVGQEAQLDDALAMYRRDGLRAERIDARQACALVPCLDETQLVGAVHDLDAMDIDVAGLHQGFLRGMARAGARLRCAAELAGAERDGQGLWTLTLHDGTRVRARAVVNAAGAWADAVARLCGAQALGIEPRRRSAFTFAAPEGEAIHDWPAVVGVDESFYFKPDAGQLLGSPANADPVAPHDVVAEELDVAIGIDRIESLTRLRIRRPRHVWAGLRSFAPDDDFVIGWDVRREGFFWLAGQGGYGIQTAAGASAAATALLMHESLPGELLAQGVDAARLSPARFSA

SEQ ID NO: 827 - DNA, 1272 bp, Unknown; identical to SEQ ID NO: 781
  Obtained from environmental sample

SEQ ID NO: 828 - protein, 423 aa, Unknown; identical to SEQ ID NO: 782
  Obtained from environmental sample
  DOMAIN (14)...(404): FAD dependent oxidoreductase
  SITE (88)...(91): N-glycosylation site. Prosite id = PS00001

SEQ ID NO: 829 - DNA, 1281 bp, Unknown
  Obtained from environmental sample
atgaataagcggacacccgaacgggttgtcgtcattggtgggggcgtggttggtgcctcgaccgcgctggcgttggccgagcgcggcctgcaggtcacactgatcgagcgcaatgccgagctggccgaggagaccagtttcgccaatggcggcggcgttaccccactgcattccgagccctggaatgcgccgggcctgttgtccaaggtggtgcgcaatctcggccgtgccgacgcaccctatcggctctctcccctggccgtgccgggcatgggtttctgggggcttggctttctgcgccacatgcgccctgaacgctaccgggccaatgcccgcaggaatatcgatctggccctttactcgctggcttgcctgcgccagtggcgcgaacgtcattcactggaataccgccagataacggccggctccatgcaggtgtatttttcgcgcgaactgatggccgaatcggtgcagctgcggcgcgaactgctcaaggaccgcgccacgatcgaaactctggatgccgatcaggcggtgacgcgggaaccggccctggccggggtcaggcagcgattggtcggtgcgatctattttcccgatcacgaatccggagatgcctgccagttcagccgcgaagcggccgcccgggccgaggggctgggcgcgcggattcactgtgagacccgggtgcactcgttccggatcgaaggcgggcaattccgggccgtggtcaccgatcagggcgagttcgaggccgatgcctgcgtgatcgcggccggtccggaatcacccaccctggcgcgccaggttggattgcgcctgcccatctacccggtgcggggctattcggccaccttccggatcgactcgaccgaggccctgcccaccctgcccatgctcgatacctcgagccgcttcgttaccgtccgcctgggcgagaacggatttcgcgtcgccgggctggccgatttcgccggtcgccgtcgcgtgatcattccccggcgggtggagagcctgctggccggcgcccgccgcctgctgcccggcctggccgcggaactggtcagcgagcgcgccgagctgtgggccggcatgcgtccggtcacccccgacggggtgccactgatcggcccgacccgaaagcctggcgtattcctgaatactggccatggccccatgggttggaccatggcctgcggctcggcccagatgcttgccgaaacgatcacgggcgccaagccggagctgaatgtggacgactacggtcctgggcgattctga

SEQ ID NO: 830 - protein, 426 aa, Unknown
  Obtained from environmental sample
  SIGNAL (1)...(24)
  DOMAIN (8)...(408): FAD dependent oxidoreductase
MNKRTPERVVVIGGGVVGASTALALAERGLQVTLIERNAELAEETSFANGGGVTPLHSEPWNAPGLLSKVVRNLGRADAPYRLSPLAVPGMGFWGLGFLRHMRPERYRANARRNIDLALYSLACLRQWRERHSLEYRQITAGSMQVYFSRELMAESVQLRRELLKDRATIETLDADQAVTREPALAGVRQRLVGAIYFPDHESGDACQFSREAAARAEGLGARIHCETRVHSFRIEGGQFRAVVTDQGEFEADACVIAAGPESPTLARQVGLRLPIYPVRGYSATFRIDSTEALPTLPMLDTSSRFVTVRLGENGFRVAGLADFAGRRRVIIPRRVESLLAGARRLLPGLAAELVSERAELWAGMRPVTPDGVPLIGPTRKPGVFLNTGHGPMGWTMACGSAQMLAETITGAKPELNVDDYGPGRF

SEQ ID NO: 831 - DNA, 1137 bp, Unknown
  Obtained from environmental sample
atgtacagcgaaacgaagacgacgagaaacgtggactgcatcgtgatcggggccggcatggcgggcgcctcggcggcggcctcgctgtcggccgaggccgaggtcgtgatcctcgaagcggaggcgcaggccggctaccactccaccggccgctccgccgcgctgtactcggcgttgtacggcaatgcgccggtgcgggcgctgacgcgggcgagcctcggcttcttccgcgagccgcgcgagcagccctacctgcgggaccgcgacaccctgttcctgatcggtgccggccagcaggcggacgccgaggccttcgctgtcgatgccgacatccgcgagcagaccgtcgcgctcagcgccgacgaggcgatggcccgcgtgcccatcctgcagcgcgagcgcgtggccggtgcgctgctggacaccggttcggccgatatcgaggtggacctggtgcaccagggcttcctgcgccaggcccgggccaacggggtggcgctgcatctgggcgcgccgctgctcgatctcggccgcgacgggggcacctggatcgcgcacaccgcgcgcggcagcttctgcgccccggtcgtcgtcaatgcagccggcgcctgggccgacgccgttgcctcgctggccggcatcgcgccgctgggcctgcagccgctgcgccgcacggccgtgctgatcgacgtgcccgaggggctcgacgcatcggcctggccggccgtcatcgccgtcgacgagagccagtacttcaagcccgacgccggcctgctgctgatctccgctgccgacgagacgcccagcctgccttgcgacgcgcagccggacgaaatggacgtggccatcgccgtcgaccgcttcgagacgctgaccggccgcgccgtgcggagcctgcgccaccagtgggcaggactgcgcgtgttcagccccgaccgcacgccggtgctcggcttcgagcccgaggcgccgggcttcttctggtgcgccggccagggcggctacggcatccagacctcgccggcgatgggccgagccgccgccgcgctggcgctcggcgcgccgctgcccgacgacctgctggcgctgggcgtccaggcgcggcacttgtcgcccgcccgtttccgcaacacctga

SEQ ID NO: 832 - protein, 378 aa, Unknown
  Obtained from environmental sample
  DOMAIN (12)...(350): FAD dependent oxidoreductase
MYSETKTTRNVDCIVIGAGMAGASAAASLSAEAEVVILEAEAQAGYHSTGRSAALYSALYGNAPVRALTRASLGFFREPREQPYLRDRDTLFLIGAGQQADAEAFAVDADIREQTVALSADEAMARVPILQRERVAGALLDTGSADIEVDLVHQGFLRQARANGVALHLGAPLLDLGRDGGTWIAHTARGSFCAPVVVNAAGAWADAVASLAGIAPLGLQPLRRTAVLIDVPEGLDASAWPAVIAVDESQYFKPDAGLLLISAADETPSLPCDAQPDEMDVAIAVDRFETLTGRAVRSLRHQWAGLRVFSPDRTPVLGFEPEAPGFFWCAGQGGYGIQTSPAMGRAAAALALGAPLPDDLLALGVQARHLSPARFRNT

SEQ ID NO: 833 - DNA, 1257 bp, Unknown
  Obtained from environmental sample
atgcatgtcatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccgggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaacacccgcctggcggtatattccggtcactgtttgaaagccctgcgcgagcgatacgagctgaactatcaccagtacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcggccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 834 - protein, 418 aa, Unknown
  Obtained from environmental sample
  SIGNAL (1)...(18)
  DOMAIN (2)...(400): FAD dependent oxidoreductase
MHVIVIGAGVVGSTTALALAERGLEVTLIERHGEPGAETSHANGGGITPGHAEPWNSPGIIRRLLTRSGEGEPFRIRPGALPGLSGWGLRFLANSRPGRYYFNARANTRLAVYSGHCLKALRERYELNYHQYTDGSLELYFSQAELDHALELRRRIGDPGVEIHLLGVREAVALEPALEPIAARLVGAMQLPLHESGDACEFSAEMVRCARSLGARVLFDTEVVTINRNNDRISGVQTDKETINTDAVVLSAGCASPSLARPLGLRLPIYPVKGYSATLELDQVELAPTMPLLDLEQRIVTARYGRRLRMAGLADFEGHDRSVRPERIARLLESAATLLPALADEIHSGKAEPWAGLRPMTPTGPPMLGPTRIPGLYLNTGHGSMGWTQAAGSAEVLADLVTGKTPVIDMRGLEAVKG

SEQ ID NO: 835 - DNA, 1395 bp, Unknown
  Obtained from environmental sample
atgctgcgccaactcaccgacttgctgggccgcgagggcgtgctcggaccggacgatgacattgcccgttatgtcagcgagccgcgcgggcgttttcatggccgccccctggccgtggctcgtccccatagcaccgatcaactggcccggctggtgaagttctgcagcgacaagcgcctgcccatggtgacccagggcggcaacaccggactggtcggcggcggatcggcttcggttgacgaaaccgaagtgatcatttgccttgaacgcttgaaccggattcgccggatcgatccggaagatgccggcctggtcgccgaggccggatgcacgctggccgcagtgcgcgaagcagccgaggaccacgccatgctctacccggtcagcctggcctcggagggcacggccaccattggcgggaccatcgccaccaatgccggcggcaacctgaccattcgctacggcaacacccgcagccaggtgctgggtctggaagtggtgctggccgatggccgcgtgtattcggaactggcgccgcttcgcaaggacaacagcggttacgacatcaagcagttgttcatcggctccgaaggcacgctgggcatcatcagtgcggccacattggcgcttgccgcccgaccggcccaaagctggaccgcacttgtggccaccgcctcgctcaagtccggactcgagttgttgaaacgattgcgaaaacatatgggcgagaccctgtcggcctgtgaattcatgccgcgcctggccatggagttcgtgctcgagtacctgggttcggcccgcgatcccttcaatgggccgcatccctggtatgtgctggtccaagtcgacagcgccatggatggagactggctggagacgcgcttgctggacatgctgcaggacaccctgtctgaaaaaatcatcagcgatgtcgtggtcgctgacagcatggccaaagccggtcagctttggcggctgcgtgaatcgatctcgcccgcccaacaaacaggtggcgccagtctgaaacacgatatttccgtaccggtgtcaagcattccggccttcgtcgaccaggccagcagtgatctggccaaggcggttccggggattcgaccgtgcatcttcggccacctcggcgacggcaacctgcacttcaacctcagccagcccgaggccatgcaagccgatcaattccgcgcactggaaagtcgctgcaaccgcatcgtgttcgaccttgtccgacaattcaacggctccatcgccgccgaacacggcattggccaattgcgtcgcgaagaattggccaccggccagccactgaaggtcgacctgatgcgcgccctgaagaagtcactggacccgcacggcctgctcaaccccggaaaggtcgtctga

SEQ ID NO: 836 - protein, 464 aa, Unknown
  Obtained from environmental sample
  DOMAIN (36)...(177): FAD binding domain
  DOMAIN (213)...(463): FAD linked oxidases, C-terminal domain
  SITE (151)...(154): N-glycosylation site. Prosite id = PS00001
  SITE (391)...(394): N-glycosylation site. Prosite id = PS00001
  SITE (423)...(426): N-glycosylation site. Prosite id = PS00001
MLRQLTDLLGREGVLGPDDDIARYVSEPRGRFHGRPLAVARPHSTDQLARLVKFCSDKRLPMVTQGGNTGLVGGGSASVDETEVIICLERLNRIRRIDPEDAGLVAEAGCTLAAVREAAEDHAMLYPVSLASEGTATIGGTIATNAGGNLTIRYGNTRSQVLGLEVVLADGRVYSELAPLRKDNSGYDIKQLFIGSEGTLGIISAATLALAARPAQSWTALVATASLKSGLELLKRLRKHMGETLSACEFMPRLAMEFVLEYLGSARDPFNGPHPWYVLVQVDSAMDGDWLETRLLDMLQDTLSEKIISDVVVADSMAKAGQLWRLRESISPAQQTGGASLKHDISVPVSSIPAFVDQASSDLAKAVPGIRPCIFGHLGDGNLHFNLSQPEAMQADQFRALESRCNRIVFDLVRQFNGSIAAEHGIGQLRREELATGQPLKVDLMRALKKSLDPHGLLNPGKVV

SEQ ID NO: 837 - DNA, 942 bp, Unknown
  Obtained from environmental sample
atgggaacaaacataggcgtagtcggaggtggcatcattggattgtcgactgcgcatcttttggcagatcagggtcataatgtcactatctataccaaggatcaacctgagcacactacatccatgaaagctgctgccatctggtttccatttaaagcagcgccgttagacaaagtcctggaatggagtgctcaatcacttgagcattatcaaataattgccgaatcaccgggctgtggtgtaaagtgggtcgaactatgggtgatggataccccggaacaagctcgatcctggattgaagctgtgcctaaggccgcataccaaatcatcacccgggaagaccttccgccagggtacgctcatggctacctcgtacaggtgccaatgattgacacctcgctattcttaccttttctctacaaccaatttcaaaataagggtaagataatttttaggaagatagcccatctggaagatttgatcccaactcatgaagtagtaatcaattgtaccggactggaagcaaatcagttaacacctgatgaaaaactattcccaatcagaggtcagatcgtaaaattattcgcacagccgggaattcgctatatggctgatgatcatgggcctaatgcattatcctacatcataccccgttccgatggcatcgtattaggaggcacggctcaactacattccgatgatttagaggttgatcacagagaaagtgaacagatattaattcgttgcagtgcactcgaaccaaacttgatcctaaatgtaaaagaatcgatagtcggtctgcggccgggaagggagactgttcgcctggagaaagagccggatctaaatataatccataactatggccatggcggatcaggctatactgtctgctggggttgtgctatggaggttgccagactcgttgctgaagtagtttga

SEQ ID NO: 838 - protein, 313 aa, Unknown
  Obtained from environmental sample
  DOMAIN (4)...(308): FAD dependent oxidoreductase
  SITE (27)...(30): N-glycosylation site. Prosite id = PS00001
  SITE (171)...(174): N-glycosylation site. Prosite id = PS00001
  SITE (288)...(306): D-amino acid oxidases signature. Prosite id = PS00677
MGTNIGVVGGGIIGLSTAHLLADQGHNVTIYTKDQPEHTTSMKAAAIWFPFKAAPLDKVLEWSAQSLEHYQIIAESPGCGVKWVELWVMDTPEQARSWIEAVPKAAYQIITREDLPPGYAHGYLVQVPMIDTSLFLPFLYNQFQNKGKIIFRKIAHLEDLIPTHEVVINCTGLEANQLTPDEKLFPIRGQIVKLFAQPGIRYMADDHGPNALSYIIPRSDGIVLGGTAQLHSDDLEVDHRESEQILIRCSALEPNLILNVKESIVGLRPGRETVRLEKEPDLNIIHNYGHGGSGYTVCWGCAMEVARLVAEVV

SEQ ID NO: 839 - DNA, 1242 bp, Unknown; identical to SEQ ID NO: 809
  Obtained from environmental sample

SEQ ID NO: 840 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 841 - DNA, 1269 bp, Unknown
  Obtained from environmental sample
ttgaagatcgccgtgctgggcgccggtgtggtgggcgtcaccacggcgtggcacctcgcggcggacggtcatgacgtggtcgtcgtcgaccgcgcgcacgcgccggcgctggagacgagctttgccaacggcgggcagatctccgcgtcgcagaccgagccgtgggcgaatccgggggcgccggggctggtgctgcgctggctcggtcgcgaggacgcaccgctgctcttccgcctgcgcgccgatcccgcgctcttcgcctggggtctgcgcttcctgctcgaatgcctccccggccgcacgcggcgcaatacgctggacgtgctcgcgctcggactctacagccgcgaggcattgcgcacgctgcgttccgcactggcgctcgactacgatcagcagacgcgcggcattctgaagcttttcgaagacgaggccgcgctggcggaagctgccgagcatgcgcacgtgctgtcggcgcgcggctgccgggtcgacgttctgacgcgcgagcagtgccttgcggtcgagcccgcgctcgcgcacgcgcaggtggcgatcgcgggcgccacgcatgcgcgggacgacgaatcgggagatgcctgcaagttcacgacggctctcgcgcagcactgccgggagcgcggcgtcgagtttcgcttcggcacggagattcaggcgctgcgctgcgaagcgaatgtcgtgcgctcgctcgtcgtcagggaacgcggcgggcacacgggagaattcggtgccgacgccttcgtggtgtgcctgggcagttacagcccgcttctcctgcgcagcgcgggcatcgccatcccggtgtatccggtgaagggttattcggtgaccgtcctgatcgaggaccccgctgcggcgcccaccgcgagcatcaccgacgaggcgcgcaagatcgtcttctcacgcctgggtgaccggctgcgcgtggccggcacggcggagatggcggggtacgacacgtcgctcaaccgcgtgcgctgcgaggccattcgcgagcgcgcgcgtcagtggttccccgcggcgagccgttacgatcgagtcgagtactgggcgggcctgcggccggcgacgccgggcaacgtgcctctcatcggccgcacgcggatcgcgaacctcttcgtcaacaccggacacggcacgctcggctggacgctctcgtgcggatccgcacaggcgctggcggacatcgttgcgggtcggcgcccgctgctggatttcccgttcctgggagccgggcgcacggcgtga

SEQ ID NO: 842 - protein, 422 aa, Unknown
  Obtained from environmental sample
  DOMAIN (2)...(403): FAD dependent oxidoreductase
MKIAVLGAGVVGVTTAWHLAADGHDVVVVDRAHAPALETSFANGGQISASQTEPWANPGAPGLVLRWLGREDAPLLFRLRADPALFAWGLRFLLECLPGRTRRNTLDVLALGLYSREALRTLRSALALDYDQQTRGILKLFEDEAALAEAAEHAHVLSARGCRVDVLTREQCLAVEPALAHAQVAIAGATHARDDESGDACKFTTALAQHCRERGVEFRFGTEIQALRCEANVVRSLVVRERGGHTGEFGADAFVVCLGSYSPLLLRSAGIAIPVYPVKGYSVTVLIEDPAAAPTASITDEARKIVFSRLGDRLRVAGTAEMAGYDTSLNRVRCEAIRERARQWFPAASRYDRVEYWAGLRPATPGNVPLIGRTRIANLFVNTGHGTLGWTLSCGSAQALADIVAGRRPLLDFPFLGAGRTA

SEQ ID NO: 843 - DNA, 1290 bp, Unknown
  Obtained from environmental sample
atgcgcgtagttatcttgggcagcggcgttatcggcgtcaccagtgcctactacctggccaaagccggccacgaagtgacggtgctggaccgcgaagccgcaccggccatgggcaccagccacgccaacgccggccagatctcgcccggctacgcctcgccctgggccgcgcccggcattccgttcaaggccatgaagtggatgctgcagcgccacgcgcccctgtcgatcaccccggacggcaccctgttccagctgaagtggatgtggcagatgctgcagaactgcaccgccgagcgctacgccgtcaacaaggaacgcatggtgcgcctggccgaatactcgcgcgactgcatcaaggccctgcgcgccgaaaccggcatcgaatacgaaggccgccagctcggcaccacccagctgttccgcacccaggcgcagctggacgccgccgccaaggacatccaggtgctggaggaaaccggcgtgccgtatgagctgctgacccgcgagcagctggtcggcgccgaaccgggcctggccggctcgctggaccgcctgaccggcggcctgcgcctgcccaacgacgaaaccggcgactgcctgctgttcaccacccgcctggccaagatggcgcaggacctgggcgtcaaattccgctacggcgtcgacatcaccggcctggtcaccgagggcgacaccatccagggcgtgcactgcggcgatgaactggtcaaggccgactcctacgtggtggcgctgggcgtgcattcgaccccgctgctgaaaggcctggtcgacattccggtctacccgctcaagggctactcgatcaccgtgccgatcgtgaacgccgacgcggccccgacctcgaccatcctggacgagacttacaagatcgcagtgacccgcttcgacgaccgcatccgcgtgggcggcatggcggaaatcgccggctacaaccgcaagctgaatccgcgccgccgcgagaccctggagatggtggtcaacgacctgttccccggcgccggcgacaccgcggcggccactttctggaccggcctgcgtccgatgaccccggacggcaccccgatcgtcggccgcaccggcgtgcgcaacctgttcgtcaacaccggccacggcaccctgggctggaccatgtgctgcggctcggcccagctgctgtcggacatcatctcggcgcgccgtcccgccatcctggccgacgacctgtcggtggcgcgctacagccgtccggacgccgtgcgccgtccgcagctggtcaacgcgtaa

SEQ ID NO: 844 - protein, 429 aa, Unknown
  Obtained from environmental sample
  DOMAIN (2)...(397): FAD dependent oxidoreductase
  SITE (96)...(99): N-glycosylation site. Prosite id = PS00001
MRVVILGSGVIGVTSAYYLAKAGHEVTVLDREAAPAMGTSHANAGQISPGYASPWAAPGIPFKAMKWMLQRHAPLSITPDGTLFQLKWMWQMLQNCTAERYAVNKERMVRLAEYSRDCIKALRAETGIEYEGRQLGTTQLFRTQAQLDAAAKDIQVLEETGVPYELLTREQLVGAEPGLAGSLDRLTGGLRLPNDETGDCLLFTTRLAKMAQDLGVKFRYGVDITGLVTEGDTIQGVHCGDELVKADSYVVALGVHSTPLLKGLVDIPVYPLKGYSITVPIVNADAAPTSTILDETYKIAVTRFDDRIRVGGMAEIAGYNRKLNPRRRETLEMVVNDLFPGAGDTAAATFWTGLRPMTPDGTPIVGRTGVRNLFVNTGHGTLGWTMCCGSAQLLSDIISARRPAILADDLSVARYSRPDAVRRPQLVNA

SEQ ID NO: 845 - DNA, 1233 bp, Unknown
  Obtained from environmental sample
atgcaaagcgcgatcgtactcggcggcggcatgatcggcgtaagcgccgcgctgcacctcaagcagcgcggctggtcggtcaccctcgtcgatcgcagggagcctggccgcgagaccagctacggcaatgccggcatgatccaggccgaagcggtgcgcccctatccgatgccgcgcgacctcgcctcgctcctgaagatcgcgaccggccgcaccaacgacgtgcgctacagcttctcgtcgcttcatcgccatatcgagccgctgctgcgctattggtggcattcggcgccgaagcggcatcgtgaggcgatcgtcggctgggcgcgcctgatcgcctatgcgacgcccgagcacgacatcctcattcgcgaagcccatgccgacaatctgatccgccgcgccggctatcgcgcgctgtatcgtgaccgcgccgcgctggacctctcgatcaaggccgcggaggaggacaagcgcgagttcggcgtgaattttcgcgtgctgtcaggcagcgagctgacaaaggccgagccgatcctgcgcgacgatctccccggcgcgatccattggctcgacacctggacggtgtccgatccgggcgcgctggtcaccgcctatgccgagctgttccagcgccttggcggcacgatcgtgctcggtgatgcgcagtcgctgcaacagaccgcgaccggctggtccgtcgatactgaccagggccgcatcgatgccgcccacgccgtcgtcacgctcggaccgtggtcgccggatctgctctacaagttcggctatcgcatcccgctggtgcgcaagcgcggctatcacatgcattacagcggcggcgcgtcgctcgatctgccgctggtcgacaagggcaacggctacgccatgggcccgatggccaagggcatccgcatcaccaccggcgccgagctgaccggaccggacgcgctcgcaacaccgatccagctcgccagcgccgaggcctccgcacgcgagctgatcgatctcggcaagcgcgccgagcccgacccgtggttcggcacccgcccctgcacgcccgacatgctgcccgtgctcggccgcgccccgcgccaccccggcctctggatgaactttggtcacggccaccaaggctttacgctgggacccgcgacggggcgcctgctcgcggagatgatgaacggcgaaacgccgtcgatcgatccgaccccgtaccggccggagcggttttaa

SEQ ID NO: 846 - protein, 410 aa, Unknown
  Obtained from environmental sample
  DOMAIN (3)...(392): FAD dependent oxidoreductase
MQSAIVLGGGMIGVSAALHLKQRGWSVTLVDRREPGRETSYGNAGMIQAEAVRPYPMPRDLASLLKIATGRTNDVRYSFSSLHRHIEPLLRYWWHSAPKRHREAIVGWARLIAYATPEHDILIREAHADNLIRRAGYRALYRDRAALDLSIKAAEEDKREFGVNFRVLSGSELTKAEPILRDDLPGAIHWLDTWTVSDPGALVTAYAELFQRLGGTIVLGDAQSLQQTATGWSVDTDQGRIDAAHAVVTLGPWSPDLLYKFGYRIPLVRKRGYHMHYSGGASLDLPLVDKGNGYAMGPMAKGIRITTGAELTGPDALATPIQLASAEASARELIDLGKRAEPDPWFGTRPCTPDMLPVLGRAPRHPGLWMNFGHGHQGFTLGPATGRLLAEMMNGETPSIDPTPYRPERF

SEQ ID NO: 847 - DNA, 1131 bp, Unknown
  Obtained from environmental sample
atgcaacaggccgactacatcatcatcggcgccggcattgccggcgcgtccaccggctactggctggcgccccacggcaaggtcctgctgctggagcgcgaaaccctgccgggctatcactccaccggtcgctcggcggcgctctacaccgctgcctacggcacgccgcaggtacgcgccctgaccctcgccagccgggccttcttcgaccagccgcccgctggcttcgccgaccacccgctactgaccccgcgcggcgagatgaccgtggacttcgaaggcgatgccgaagaactccagcgccagttcgaaagcgcccgcacctgcgtgccggacatgcagttgctcgacgccgatgaagcctgcgcgcggattccggtgctcaagcgggaaaaggtccacggtgccctgtacgaccccagcgccagcgatatcgataccgacggcctgcaccagggctacttgcgcggcatccgtcgccagcagggcgagatccatggcgattgcgaggtgctgggcctggacaaggatgcgcagggtcagtggctcgtcgaaacctcacgcggtaagttccgcgccccggtgctgatcaatgccgccggaggctgggccgacaggatcggtgagctggccggggccaggccgctgggcctgcaacccaagcgccgcgccgcgttcatcttcgaagcgccggcaggcatcgacacccacgcctggccgatgctggtcagcctggacgagtcgttctacatgaagcccgacgccggcatgctcctgggttcgccgtgcaacgccgacccggtcgagccccacgatgtacagccggaagagctggacatcgccctgggcatctaccagatcgaggaagccaccaccctgacgatccgccgccccttccgcacctgggccgggctgcgcagcttcgttgccgacggtgacctggtggccggcttcgatcccttggtgagcggcctgttctgggtcgccgcacaaggtggctatggcatccagacctcgccggccatgggccaggccagcgccgcgctggtgcgtggggaagaattgccggccgaattgcgtggcttcggcctgagcgccgcacaactgtcacccgcgcgcctcggcgggtga

SEQ ID NO: 848 - protein, 376 aa, Unknown
  Obtained from environmental sample
  DOMAIN (5)...(349): FAD dependent oxidoreductase
MQQADYIIIGAGIAGASTGYWLAPHGKVLLLERETLPGYHSTGRSAALYTAAYGTPQVRALTLASRAFFDQPPAGFADHPLLTPRGEMTVDFEGDAEELQRQFESARTCVPDMQLLDADEACARIPVLKREKVHGALYDPSASDIDTDGLHQGYLRGIRRQQGEIHGDCEVLGLDKDAQGQWLVETSRGKFRAPVLINAAGGWADRIGELAGARPLGLQPKRRAAFIFEAPAGIDTHAWPMLVSLDESFYMKPDAGMLLGSPCNADPVEPHDVQPEELDIALGIYQIEEATTLTIRRPFRTWAGLRSFVADGDLVAGFDPLVSGLFWVAAQGGYGIQTSPAMGQASAALVRGEELPAELRGFGLSAAQLSPARLGG

SEQ ID NO: 849 - DNA, 1269 bp, Unknown
  Obtained from environmental sample
gtgagggtcctcgttctgggcgcgggtgtggtgggtacggccacggccctggcgctggcccggcgcggcctggatgtgaccctgatcgagcgcgaggaggagcccgcccgcggcaccagccacgccaatggcggcggcatcaccccggcccacgccgaaccctggaacgcgccgggcatcggctggatgctgctgcgctggctgggccgacgcgacgcgccgttccggctgagaccctcggcgatcccgggcatgacgcgctgggggctggcctttctggcccactccaggcgcaggcgcttcatcgaaaacgcccgcgcaagcatccgcctggcggtgtattcgggacaacggctgaaggcctggcgcgatgaactggagctggaatacgggcagcgcacgctgggctcgatcaaggtcttctggacccgtcgcgagctggataagtccctgaaactgctgaccggcgtcggccatccagaggtggcctggaaggcgttgtcgccggccgaggcggtggagctcgagcccgccctgggcccggttgccgaaaggctggccggcacgctgcactttcccggcaacgagtcgggcgacgcccgccggttcagcctggccgcggccgagaaggcgcgcgagctcggcacgcggttgcagttttcaaccgccgtggagtccatcgaatgcgacgcctggggtttccggagcgtgcgcacgagccagggtgatttcgaggccgaggcctgcatcgtgtgcctgggctgcgacagtccggcgctgctcaacccgctgggcgtgcgcgtgccgatctacccggtcaagggctactcggccacccttgagcttgacgatcccgccgccgcgccggctggctgcgtgctcgacgcgggccaccgggtgatcgtcacccggctgggcgagaaggtgctgcgagtggccgggaccgccgagttcgccggccacgacctggaaatcgaccgggtacgggcccgctcgatgctcgacagcgcactggcggtgtttccggcgctgggccgggaaatcgagggacgcgagcccgagttctggaccgggctgcgccccatgaccccggatgggccgccgctgctcggccgcgccggcccgcgcggggtctggctgaacaccggccacggctccatgggctggacccaggcggccggctcggccgagatcctggccgacctgatcaccggaaagtcgccggccatcgacgtgtccgggctcgaagcagcgcgctggaaccagtaa

SEQ ID NO: 850 - protein, 422 aa, Unknown
  Obtained from environmental sample
  SIGNAL (1)...(18)
  DOMAIN (2)...(402): FAD dependent oxidoreductase
MRVLVLGAGVVGTATALALARRGLDVTLIEREEEPARGTSHANGGGITPAHAEPWNAPGIGWMLLRWLGRRDAPFRLRPSAIPGMTRWGLAFLAHSRRRRFIENARASIRLAVYSGQRLKAWRDELELEYGQRTLGSIKVFWTRRELDKSLKLLTGVGHPEVAWKALSPAEAVELEPALGPVAERLAGTLHFPGNESGDARRFSLAAAEKARELGTRLQFSTAVESIECDAWGFRSVRTSQGDFEAEACIVCLGCDSPALLNPLGVRVPIYPVKGYSATLELDDPAAAPAGCVLDAGHRVIVTRLGEKVLRVAGTAEFAGHDLEIDRVRARSMLDSALAVFPALGREIEGREPEFWTGLRPMTPDGPPLLGRAGPRGVWLNTGHGSMGWTQAAGSAEILADLITGKSPAIDVSGLEAARWNQ

SEQ ID NO: 851 - DNA, 975 bp, Unknown
  Obtained from environmental sample
gtgtgttccgaggagcgagctatgaccccaaccgtggccgtcgtcggggccggtgtgatcggtctcagttgtgcgctcgagttggctcgaaccggcgcacacgtcaccgtgtacgccgatagttccgccgatggaaccggcacaacatcggtgatcgctggtgcgatctggtttccctacctcgcacagcccagagaagctgtgagccgatggtcggccgagaccctcaccaaactctcggagctcgccgccacccccgacacgggtgtgctcctgcggcgtggccgagtgctgctgcgccgccgcgacacggacctcgcctggacagcgtcgatcaacgactaccgcaccctcgaccaggggcttcccagcggtgtgctctcggcgatcgagtgcaccctccccgtggtgaacatggcggtctacctcggttggctcacagcagagtgtcgagcgtggggcgtgccaattgtgcgccgccgcgtgacgagtctgtcagagatcgatgatcgattcaccacggttgtcgtcgccaccggtttacgctccgccgagttgcttgaagaggatcgtctctacccggttcggggccaggtggtgcggctgcggaacccgggaatcaccgactggctcatcgacgacgacaatccggcaggcatcacctacgtctttccgcgcggtgacgacgtggtgtgtgggggaacagccctgatcggtgataacagcacggcggtgaacccggaggtcgaagcgcgcattctcgagcgggctcgagcgctggtaccggctctgcggaacgagcccgtggtgagccgagccactggcctgcgacccgctcgcgacgccgtgcggctcgagcgggtggccggcgccgaccgcgacgttatcgcctgctacggccacggcggtgcaggggtcaccctgtcatggggctgcgccgcagaagtcgcctccctggtggcgatgggatcgtga

SEQ ID NO: 852 - protein, 324 aa, Unknown
  Obtained from environmental sample
  DOMAIN (11)...(319): FAD dependent oxidoreductase
  SITE (244)...(247): N-glycosylation site. Prosite id = PS00001
MCSEERAMTPTVAVVGAGVIGLSCALELARTGAHVTVYADSSADGTGTTSVIAGAIWFPYLAQPREAVSRWSAETLTKLSELAATPDTGVLLRRGRVLLRRRDTDLAWTASINDYRTLDQGLPSGVLSAIECTLPVVNMAVYLGWLTAECRAWGVPIVRRRVTSLSEIDDRFTTVVVATGLRSAELLEEDRLYPVRGQVVRLRNPGITDWLIDDDNPAGITYVFPRGDDVVCGGTALIGDNSTAVNPEVEARILERARALVPALRNEPVVSRATGLRPARDAVRLERVAGADRDVIACYGHGGAGVTLSWGCAAEVASLVAMGS

SEQ ID NO: 853 - DNA, 1131 bp, Unknown; identical to SEQ ID NO: 847
  Obtained from environmental sample

SEQ ID NO: 854 - protein, 376 aa, Unknown; identical to SEQ ID NO: 848
  Obtained from environmental sample
  DOMAIN (5)...(349): FAD dependent oxidoreductase

SEQ ID NO: 855 - DNA, 1173 bp, Unknown
  Obtained from environmental sample
atgcagaaagatatctgggatttcgtcatcgtgggcgcgggcatggccggagcctccaccgcctggcagctggcgcagtcgggtggcgagaacccgccctcggtgctggtgctggagcgcgaatcccagcccggctatcacaccaccggccgctcggcagcgctgtttgaagagcattacggtcccgcccaggttcaggccctgacccgcgccagccgcgccttctacgatgcgccaccggccggttttgccgaagcccccatcctcacgccgcgcggcgtgctctatgtgggcacggccgatcagcgggatctggtggatgctgcctacgccgaggcccaggttcactcccccgatgcccagcgcctgagcgccgcacagctcaagaccctggttcccgtgctcgacaccgaggtgctggtggacggctttctcgataccggtgcgcgtgacatcgatgtgcacggcctgcaccagggctatatccgcggcctgcgccagcgcggcggcgacctgtggtgcaacgccgaggtccaggccatcacccgggtcaatgacttctggcacattgccctgccccagggccggagccttcgttccaaggtaatcgtcaacgccgccggagcctgggtggatgtcgtggccgccatggtcggagcggctcccattggcatcaccccaaaacgccgcagcgccttcaccttccctgtccccgaaggcttggacgccacgctctggcccgccatcatcagcgccgatgaaaactggtacatcaagcccgacgccggccagctgctgggctcccccgccaatgcagatcccgtggcaccgcacgatgtcgtgcccgaagagctggacattgccatcggcatccatcacatcgaggaagccaccacgctgcaaatccgccgcccctcgcatacctgggccggcctgcgcagctttgtcgccgatggcgagctggtgatcggctgggatgcctcgcccacgcccgtgccgggctttttctgggtcgccgcccaaggcggctatggcatccagagcgccgccggctacagcctgctggcgcgcaatctgctgctcggggaaacgctggatgcggcgctggccgcacagaaggtgaatgtgggggcagtgtcgcctgcgcgttgtcagctggcgactcagaattga

SEQ ID NO: 856 - protein, 390 aa, Unknown
  Obtained from environmental sample
  DOMAIN (7)...(359): FAD dependent oxidoreductase
MQKDIWDFVIVGAGMAGASTAWQLAQSGGENPPSVLVLERESQPGYHTTGRSAALFEEHYGPAQVQALTRASRAFYDAPPAGFAEAPILTPRGVLYVGTADQRDLVDAAYAEAQVHSPDAQRLSAAQLKTLVPVLDTEVLVDGFLDTGARDIDVHGLHQGYIRGLRQRGGDLWCNAEVQAITRVNDFWHIALPQGRSLRSKVIVNAAGAWVDVVAAMVGAAPIGITPKRRSAFTFPVPEGLDATLWPAIISADENWYIKPDAGQLLGSPANADPVAPHDVVPEELDIAIGIHHIEEATTLQIRRPSHTWAGLRSFVADGELVIGWDASPTPVPGFFWVAAQGGYGIQSAAGYSLLARNLLLGETLDAALAAQKVNVGAVSPARCQLATQN

SEQ ID NO: 857 - DNA, 1173 bp, Unknown; identical to SEQ ID NO: 855
  Obtained from environmental sample

SEQ ID NO: 858 - protein, 390 aa, Unknown; identical to SEQ ID NO: 856
  Obtained from environmental sample
  DOMAIN (7)...(359): FAD dependent oxidoreductase

SEQ ID NO: 859 - DNA, 1173 bp, Unknown; identical to SEQ ID NO: 855
  Obtained from environmental sample

SEQ ID NO: 860 - protein, 390 aa, Unknown; identical to SEQ ID NO: 856
  Obtained from environmental sample
  DOMAIN (7)...(359): FAD dependent oxidoreductase

SEQ ID NO: 861 - DNA, 987 bp, Unknown
  Obtained from environmental sample
atggcgcattatgacgcggttgtggtcggcgccggtgttgtcgggctgaccaccgccgtctcgctcgccgaggcaggcctgagcacccgggttgtcaccgccgctttgccgtcggacaccacctcggtggcggcgggcgcgatctgggggccggtgctgtgcgggccgccgaaccgcgcttacgagtggtcgcgcaccggcctgtcggtgctctcggagctggcggacgagcccgcggcggcgatccgccaggtcagcggggtggaggtcgctacgtccccggtgccgccgcccggctggacggacctgctgcctgacctgcggctgctcggcgccgatgagctcccgtccggcttcgcctgcggctggcgctacaccgcgcccgtggtcaccatgccgctgtacctggagtacctgcggcagcggttcgaggccgcgggcggttcggtcgagatcgcgcccgtcacgtcgctggccgggctggccgggctgtccggcgctccggtcgtggtgaactgcaccggcgtcggcgcccgggacctggtgcccgaccccgcggtcgtgccggtccgcggccaggtcgtcgtggtgaagaatcccgggatcgacgagttctacatcgaccacacgctgcacggcacggattacatctacgtgttcccgcacggcgacgtggtgctgctcggcggaactgccgaggaaggcgcctgggatatgcccgctcgttcagctatatcagaacggatactggcagactgctcgacgatattcccccgcttgcgcggggcggaggtggtggagcaccgggtcgggctgcgcccgtaccggccgacggtgcggctggaagcggaagctctgcctgccacaccggcggcgagcgggcgggtgctgtggcacaactacgggcacggcggcggcggggtcacgctgtcctggggctgcgcccgcgagatcaccgacgcggtgctcgcgggcgcatgggcatga

SEQ ID NO: 862 - protein, 328 aa, Unknown
  Obtained from environmental sample
  SIGNAL (1)...(23)
  DOMAIN (5)...(321): FAD dependent oxidoreductase
  SITE (174)...(177): N-glycosylation site. Prosite id = PS00001
MAHYDAVVVGAGVVGLTTAVSLAEAGLSTRVVTAALPSDTTSVAAGAIWGPVLCGPPNRAYEWSRTGLSVLSELADEPAAAIRQVSGVEVATSPVPPPGWTDLLPDLRLLGADELPSGFACGWRYTAPVVTMPLYLEYLRQRFEAAGGSVEIAPVTSLAGLAGLSGAPVVVNCTGVGARDLVPDPAVVPVRGQVVVVKNPGIDEFYIDHTLHGTDYIYVFPHGDVVLLGGTAEEGAWDMPARSAISERILADCSTIFPRLRGAEVVEHRVGLRPYRPTVRLEAEALPATPAASGRVLWHNYGHGGGGVTLSWGCAREITDAVLAGAWA

SEQ ID NO: 863 - DNA, 1299 bp, Unknown
  Obtained from environmental sample
atgcgggttctggtgcttggtagcggtgtgatcggtacggccagtgcgtattacctggcccgccagggcttcgaggtggtggtcgttgatcgccaggacggcccggccatggaaaccagcttcgccaacgccggccaggtatcgccgggttatgcctcgccctgggcggcgccgggtatcccgttgaaggcgatgaagtggctgctgctaaagcacgcgccgctggccatcaagctgactggcgatgttgatcagtacctgtggatggcgcagatgctgcgcaactgcaccgccgcccgctacgcggtgaacaaggaacgcatggtgcgcctgtccgagtacagccgtgattgcctcgacgagctgcgcgcggaaaccggcattggctacgaagcacgccagcttggtaccacccagctgttccgcacccaggcgcagctggacaacgccgccaaggatatctcggtgctcgagcaatccggcgtgccctacgagctgctcgatcgcgccggcatcgccaaggtcgaaccggccctggccagcgtcaccgacaaactcgctggcgccctgcgtctgcccaatgaccagaccggtgactgccagctgttcacccgcaaactggccgagatggccaccgcgctgggcgtgcagttccgtttcggcaagaacatccagcgcctggatgtcgccggtgaccgtatcaacggcgtgtggattgacggcaagctggaaaccgccgaccgctacgtactcgccctgggcagctacagcccgcaactgctcaagccgctgggcattcgcgcgccggtctatccgctcaaggggtactcgctgacggtgccgatcaccaacccggacatggcgccgacgtcgaccatcctcgacgaaacctacaaggtcgccatcacccgcttcgaccagcgcatccgtgtgggcggcatggccgaaatcgccggcttcgacctgagcctcaacccacgtcgtcgcgaaactttggaaatgatcgtcggtgatctgtatccccagggcggtgacctgagccaggcggatttctggaccggtttgcgcccggcgacccctgatggcacgcccatcgttggcgccaccccctatcgaaacctgtttctgaacaccggacacggtaccctaggctggaccatggcctgcggctccggtcgcctgctggccgacctgatcgccaggaagcgcccgcagatcagcagcgaaggcctggatatttcccgttacggtagccccaaggagttgaacaagcatgtccatacagcgcctgcgaactga

SEQ ID NO: 864 - protein, 432 aa, Unknown
  Obtained from environmental sample
  DOMAIN (2)...(398): FAD dependent oxidoreductase
  SITE (96)...(99): N-glycosylation site. Prosite id = PS00001
MRVLVLGSGVIGTASAYYLARQGFEVVVVDRQDGPAMETSFANAGQVSPGYASPWAAPGIPLKAMKWLLLKHAPLAIKLTGDVDQYLWMAQMLRNCTAARYAVNKERMVRLSEYSRDCLDELRAETGIGYEARQLGTTQLFRTQAQLDNAAKDISVLEQSGVPYELLDRAGIAKVEPALASVTDKLAGALRLPNDQTGDCQLFTRKLAEMATALGVQFRFGKNIQRLDVAGDRINGVWIDGKLETADRYVLALGSYSPQLLKPLGIRAPVYPLKGYSLTVPITNPDMAPTSTILDETYKVAITRFDQRIRVGGMAEIAGFDLSLNPRRRETLEMIVGDLYPQGGDLSQADFWTGLRPATPDGTPIVGATPYRNLFLNTGHGTLGWTMACGSGRLLADLIARKRPQISSEGLDISRYGSPKELNKHVHTAPAN

SEQ ID NO: 865 - DNA, 861 bp, Unknown
  Obtained from environmental sample
  misc_feature (1)..(861): n is a, c, g, or t
atgaaaatgatcggatattataacggagtgcttggcaatctgcaggaaatgcagattccgatgcaggatcgggcgctgtatttcggagacggcgtctatgatttcactcctgcctacaacggcaaactgtttgccatcgaagaccatctcgaccgttttttccattccatggaaatgctgtcgatccgcccttactgtgatcgggaaactctgaagaaggaactggaacgctgcgtggcggcgacggaaagcacggaaccgatggcggtttactggcagacttcccgcggcaactgccggcgcaatcatatttttccgccggagggaacaccgactacgcttctgatcacggtcacaccattgaaaccgctggatccgaatgtatcactgaagctggcttcgtttgaagacaagcgttttcagtactgcaatatcaagacactgaatctgattcccaatgttctggccgcgcagtacgcggaagagcagggatgtcaggaagctgtgttccaccgcggtaagtttgtaatggaatgcgcccacagttcactcgtcctgctgaaggacggtgtactgatggcaccgccgctcgatgacaggatactgccgtccatcacccgcaaacatatcacggccatctgcaaaacactggatgttccggtcgaggaaagaaagatcacgatggatgaactgtatgaagcggacgaactgatcgttctgagttccagcaagctgattgcccgggccaatgtactggatggcaaaccggtcggcatgagtgactccatgctgttcacgatgatccgagacgcatatttcaggatggtcgaaaaagaaaccggctatcgtatcggagagtag

SEQ ID NO: 866 - protein, 286 aa, Unknown; identical to SEQ ID NO: 54
  Obtained from environmental sample
  DOMAIN (8)...(273): Aminotransferase class IV
  misc_feature (1)..(286): Xaa is any amino acid

SEQ ID NO: 867 - DNA, 1062 bp, Unknown; identical to SEQ ID NO: 31
  Obtained from environmental sample
  misc_feature (1)..(1062): n is a, c, g, or t

SEQ ID NO: 868 - protein, 353 aa, Unknown; identical to SEQ ID NO: 32
  Obtained from environmental sample
  DOMAIN (14)...(347): Aminotransferase class I and II
  misc_feature (1)..(353): Xaa is any amino acid

SEQ ID NO: 869 - DNA, 852 bp, Unknown
  Obtained from environmental sample
  misc_feature (1)..(852): n is a, c, g, or t
atgtattcattatggaatgatcaaatagtgaaggatgaagaagtaaagattgataaagaagaccgaggctatcaatttggagacggcatatacgaagtaattaaagtgtatgacggtgaaatgtttacagctgaggaacatatcgatcgtttttatgaatgtgcagaaaaaattcgattaacaattccatatacgaaacataaacttcatcaattgttacatcaattagtagaagcaaatgagttaaagacaggacatatctatttccaaattacacgtggggttgcgtcacgagtacacaatttcccagcaggcaatgtgcagcctgtattatcagggacgacaaaagaatttccaagacctgtagaaaactttgaaaaaggggtaaaggcaacttttacagaagatattcgttggctacgatgtgatataaaatcactgaacttattaggtgcagtattagcgaaacaagaagcgattgaaaaagggtgttacgaagcaattttacatcgtgatggaatagtaacagaaggctcttcaacaaatgtatttggcatcaaaaatggaactctctatacacatcctgcaaacaatttaattttgcgcggaattacacgcggtgttattttaacttgtgcaaaggaaatagagctaccagtagtagagcaaccatttacgacaaaacaggcgttagaaatggatgaattatttgtttcatcaacaacttctgaaattacgccggttattgagatcgatggtgtcaaaataaataatggtgttattggagaatggacacgtaaattacaaaaacaatttgaaacgaaaattccaacaccttttacgaataaatag

SEQ ID NO: 870 - protein, 283 aa, Unknown; identical to SEQ ID NO: 42
  Obtained from environmental sample
  DOMAIN (6)...(273): Aminotransferase class IV
  misc_feature (1)..(283): Xaa is any amino acid

SEQ ID NO: 871 - DNA, 1350 bp, Unknown
  Obtained from environmental sample
  misc_feature (1)..(1350): n is a, c, g, or t
atggctctcgaacatgcctatcgtcaagcgctcccggcctcacgcgcgctctttgagcgcgcccaacacctcttcccagacggggtcactcacgataaccgccgtatgcagccttttccaatctttgtcgaacgcgccgatggtgcctacaaatgggatgtcgatggtcgacagtacatcgactactggatgggccatggcgccctcattatggggcataaccctccgcacgtgcgtgatgccgtcattgagcaggcggcgcgtggcacgcattacggcgccagccatgctctcgaagtatcatgggccgaatgggtctgcaagctggtgccatgtgctgagcgcgtacgcttcacggcctcgggcactgaggcgacgcatatggccctgcgtctggcccgcgcctatacgggcaagcgcaatgtcatcaaattcgccgggcacttccacggctggcacgagggtctagaagtgggtgtgcaaaccccctatgagatggtgccagagccagggcaaatgcaagaggcggtggacgcagtcgccctgtgccccccgaatgatatcgaggctgtccgggctgccctcgccgctggcgacgtggccgctatcatcctcgaacctacgggtggccactttggcacggtgccggtggcgccagattttttacagcgtctacgcgaagaagccaccagggccggagtcgtactcattttcgacgaggtagtgacaggttttcgcgttgcgccaggcggggctcaggaactctacggggttacgcctgacctctccacgttcgccaaaattctcgctggtggtctaccaggtggggctgtcgctggccgcgccgagatttttcattatctggcgacgcctacaaccactgaggtgggaaagcgtgcgaagattcaccatcctggcacgttcaacgccaaccctctctcggccgcggccggtgtggccatgctgtcgtccctggccgatggtacccccatcaagcgcgccaacgagcaggctgccaagctgcggcacggcatgaacgatatcctggcacgcgaaaaagtcgcctggaaggtctacggccagcacagcgattggaagctgttctatggggctgacgccccaccgcgtgacggcgctgaccagtccgtggatgacatcccctggcagcgtcttgatggcaaattcccacagcagagccgggccatgcggcaggcgctcattttacagggcgtcgattttaacggcgcacgtgctctggtgggtacctgccatactgatgatgtggtcgctgatacgctagcgggctttgcagaggcggtgcgggccgtcaaagctgacgggctcgcgtag

SEQ ID NO: 872 - protein, 449 aa, Unknown; identical to SEQ ID NO: 44
  Obtained from environmental sample
  DOMAIN (42)...(375): Aminotransferase class-III
  misc_feature (1)..(449): Xaa is any amino acid

SEQ ID NO: 873 - DNA, 1401 bp, Unknown
  Obtained from environmental sample
  misc_feature (1)..(1401): n is a, c, g, or t
atgagcaccccgccgaccaatccgccgaccaattcggcgatcatcacggactacaaggcgcggacccaggggtccggtgcgctgtttgagcgcgcccgcaaggtgctgcccagcggcatcacgcacgatgcgcgctatctcgacccgtactcgatccacgtcgccaaggccaagggcgcccgcaagtgggatgtcgatggcaacgagtatgtggactatttcggcggccatggcgccatgctgctcggccattcgcacccggcggtggtcgaggcggtgcagaagcagatggagctcggcacgcactatggctcgagccatgagctggaggtgcgctgggccgagctggtctgcgagctgacgccgtgcgccgagaaggtgcgctttaccgcgtcgggcaccgaggcctcgcacatggcgatccgcctggcgcgcgcctacaccggcaaggacaagatcgtgcgtttcatcggccacttccacggctggcacgacaacgtgacggccggcgccggcgccacctacgacggtggcaccacgccgggcgtgccgcaggacgtgagcgcgctctcgatcgtgatgccgagcgacaacgtcgccgcggtggtgaagctgatcgaggagcgtgacgacatcgccgccgtgatgttcgagccgtcaggcgcctcgtggggccaggcgcccttgccgccgggcttcatccaggcggtgcgcgacgccacgaagaagaagggcgtcatcatgctgatggacgaggtgatcaccggctatcgctggtcgtccggcggcgcgcagaaggcgttcggcatcacgcccgacctctgcatccaggccaagatcgtcgccggcggcctgccgggcggcgcggtcgcgggcaagcgcgacatcctcgaccgcatcgatcacgacgccacggcggcgaagaagatcgagcgtatcctccatcccggcacctacaacgccaatcccttgtccgccgcggcggcggtgacggcgctcacgctggtgcgcgaccaggacctcgccgagaaggccaacaagacggcggccgaattgcgcaaggcgctgaccgaggtgctggtgaaggaaggcgtgccgtggggcatctacggccagagctcgaccttcctgatctatcccaacccgttcaacgatccgatcgatcccgcgaccttcgatccgctgaaggtgccgttcgccaagctcaagggcgcgcgcggtgcgggtccgctcaccggcaagatccgcatgggcctgatgacccatggcgtcgatgtcatgggcgcgcccggcggcttcgtctcggcgacccatggcggcgccgaaatcgagaggacggtgcacgcgctgcgcgagaccgtccgcgcgctcaaggccgagcgtgaagtgaaggcggcctag

SEQ ID NO: 874 - protein, 466 aa, Unknown; identical to SEQ ID NO: 48
  Obtained from environmental sample
  DOMAIN (53)...(371): Aminotransferase class-III
  misc_feature (1)..(466): Xaa is any amino acid

SEQ ID NO: 875 - DNA, 1344 bp, Unknown
  Obtained from environmental sample
  misc_feature (1)..(1344): n is a, c, g, or t
atgacccaaccgacaccgactgccaccgtgctcgacacctaccgcacgctccacccgaagtcgggcgccctctacgagcgggcgcgcgccgtcatcgcgggcgggatcacccacgacggccgccatctctcgccgtttccgctctacgtcgagcgcgccctcggcccgcggaagtgggacgtggacggccgcgagtacatcgactactggatgggccacggcgcgctctttctcggccactgccaccccgccgtggtcaaggccgtccaggaacaggttgcgcgcggaacccacctgggcgcctcccacgagctcgaggtgcggtgggcggagctgatcaccaagctcgtgccctccgccgaaatggtccgcttcaccatgtccggcacggaggcgacgcacctcgcccttcgcatcgcgcgcgccttcacggggcgccccaaggtggtgaagttccacggccacttccacggctggcacgacggcgtggtggcggcggtcaacccgcccttcgacgtgccgatgtcggctggcgtccccgccgccactctcgatcagctgctgctggccccgcccaatgacatcaaggcagtggagatgctgctcgagcgcggcgacgtggcggcggtgatcctcgagcccgcgggcggccagtcgggaaccacgcccaccatccccggctatctgcaggagctgcggagtctctgcacgcgtcactccgtcgtcctgatcttcgacgaggtcatcaccggcttccgctactcgcccggcggcgcccaggcgtacttcggcgtgacccccgacatgacgacgctcgccaagatcgtcgcgggcggcctcccgggggcggcggtggtggggcgcaagcccatcatgtcgatgatggcgcaccggggcgatcccgcgtgggatcggagtgagcgcgtcgcccagaacgggaccttcaactccagccccgtctgcgccgccgccgccatcgccaccctcgagctcgtgagcgacggctcgctgcacgcccgcgccaacaagctcggcgacgagctccgcaccggtgtcaccgaggtgatgaagcgcgccggtatccccgggacctgcttcggcgaggcgtcgattttccacgtgtccttcgagggcaagccgggcctcgccggcttcgaccgcccgcggcgcggcgacctctaccagcgcctgcgctgcgccctgatcaacaacggggtggactgcgcgagccagcacgggtgggtctccgccgttcacaccgacgccgacatcgagcaaacgatcgccgcccacggcaaggcgttcgcggccatggccgccgacggcagcttccgggggatgtag

SEQ ID NO: 876 - protein, 447 aa, Unknown; identical to SEQ ID NO: 52
  Obtained from environmental sample
  DOMAIN (49)...(375): Aminotransferase class-III
  misc_feature (1)..(447): Xaa is any amino acid

SEQ ID NO: 877 - DNA, 1389 bp, Unknown
  Obtained from environmental sample
  misc_feature (1)..(1389): n is a, c, g, or t
atgagcaccccgccaaccaattcggcgatcatcacggactacaaggcgcggacccaggggtcgggtgcgctgtttgagcgcgcccgcaaggtgctgccgagcggcatcacgcacgatgcgcgctacctcgacccctattcgatccacgtcgccaaggccaaggggccacgcaagtgggacgtcgatggcaacgagtatgtggattacttcggcggccacggcgccatgctgctcggccattcgcaccccgccgtcgtcgaggcggtgaagaaacagatcgagctgggcacccattacggctcgagccacgagctcgaggtgcgctgggccgagctggtgtgcgagctgacgccgtgcgccgagaaggtgcgcttcaccgcatcagggaccgaggcctcgcacatggcgatccgtctcgcccgtgcctacaccggcaaggacaaggtcgtgcgcttcatcggccatttccatggctggcacgacaatgtcacggccggcgccggcgcgacctatgacggcggcaccacaccgggcgtgccgcagcaggtgagcgacctctcgatcgtgatgccgagcaacgacgtcgccgccgtggtcaagctgatcgaggagcgcgacgacatcgccgtggtgatgttcgagccctccggcgcctcctggggccaggtgccgctgccgccgggcttcgtccaggcggtgcgcgacgccacggccaagaagggcgtgctgatgctgatggacgaggtgatcaccggctaccgctggtcgtcgggcggcgcgcagaaggcttttggcatcacgcccgacctctgcatccaggccaagatcgtggccggcggcctgccgggcggcgcggtcgccggcaagcgcgacatcctcgaccgcatcgatcacgacgccaccgcggcgaagaagatcgagcgcatcctccatcccggcacctacaacgccaacccgttgtcggccgcggcggcggtgacggcgctcaccctggtgcgcgacgaggatctcgcggagaaggccaacaagaccgcggccgagctgcgcaaggcgctgaccgaggtgctggtgaaggagggcgtgccgtggggcatctacggccagagctcgaccttcctgatctatcccaatccgttcggcgatccgatcgatcccgcgaccttcgatccgcagaaggtgccgatcgccaagctcaagggcgcccgcggcgccggcccgctcaccggcaagatccgcatgggcctgatgacccacggcgtcgacgtgatgggtgcgcccggcggcttcgtctcggcgacccacggcggcgccgagatcgagaagaccgtccatgcgctgcgcgagaccgtgcgggcgctcaaggccgagcgcgaagtgaaggccgcgtag

SEQ ID NO: 878 - protein, 462 aa, Unknown; identical to SEQ ID NO: 38
  Obtained from environmental sample
  DOMAIN (49)...(367): Aminotransferase class-III
  misc_feature (1)..(462): Xaa is any amino acid

SEQ ID NO: 879 - DNA, 1398 bp, Unknown
  Obtained from environmental sample
  misc_feature (1)..(1398): n is a, c, g, or t
atgagcaccccgaccaatccggcgaccaattcggccatcgtcaccgactacaaggcacggacccagggctcgggtgcgctgtttgaacgcgcccgcaaggtgctcccgagcggcatcacgcacgatgcgcgctatctcgacccctattcgatccacgtcgccaaggccaagggcccgcgcaaatgggacgtcgatggcaacgaatatgtggactatttcggtggccacggcgccatgctgctcggccattcgcaccccgcggtgatcgaggcggtcaagaagcagatggagctgggcacgcactacggctcgagccacgagctcgaggtgcgctgggccgagctggtgtgcgagctgacgccctgtgccgagaaggtgcgcttcaccgcctcgggcaccgaggcgtcgcacatggcgatacgtttggcgcgtgcctacaccggcaaggagaagatcgtccgcttcatcggccacttccacggctggcacgacaacgtcacagccggcgcgggcgcgacctacgacggcggcaccacgccgggcgtgccgcaggaggtgagctctctttcgatcgtcatgccgagcgacaacgtcgccgcggtcgtgaagctgatcgaggagcgcgacgacatcgccgcggtgatgttcgagccgtccggcgcctcgtggggccaggcgccgctgccgccgggcttcatccaggcggtgcgcgacgccacggccaagaagggcgtcgtcatgctgatggacgaggtcatcaccggctatcgctggtcgtcgggcggcgcgcagaaggcgttcggcatcacgcccgacctctgcatccaggccaagatcgtcgccggcggcctgccgggcggcgcggtcgcgggcaagcgcgagatcctcgatcgcatcgatcacgatgcgacggcggccaagaagatcgagcgcatcctccatcccggcacctacaacgccaacccgttgtcggccgccgcggcggtgacggcgctcaccctagtgcgcgacgaggatctctcggagaaggccaacaagaccgcggccgagctgcgcgcggcgctcaccgaggtgctggtgaaggagagcgtgccgtggggcatctacggccagagctcgaccttcctgatctatcccaacccgttcaacgatccggtcgatcccgcgaccttcgatccgctcaaggtgccgttcgccaagctcaagggtgcgcgcggcgcgggtccgctcaccggcaagatccgcatgggcctgatgacccacggcgtcgacgtgatgggcgcgcccggcggcttcgtctcggcgacccacggcggcggcgagatcgagaagaccgtccacgccttgcgcgagacggtgcgcgcgctcaaggccgagcgggaagtgaaagccgcctag

SEQ ID NO: 880 - protein, 465 aa, Unknown; identical to SEQ ID NO: 84
  Obtained from environmental sample
  DOMAIN (52)...(365): Aminotransferase class-III
  misc_feature (1)..(465): Xaa is any amino acid

SEQ ID NO: 881 - DNA, 873 bp, Unknown
  Obtained from environmental sample
  misc_feature (1)..(873): n is a, c, g, or t
atgagcacagtatatttaaatggccagtttatgccggccagcgaagcgcggatttcaccaatggatcgtggctttttatttggtgacggaatctatgaggtgatcccaacctatcacggtcgttatgttggctttgcgccgcatatcgcacggatgcatgaaggcttagctgcacttaatattcagcatggtatgaccgagcagcgctggcgcgagctttgcgatcagctgctcgagctaaaccggccagaactgggtgagaatttgggcgtttatattcaggtcagccgcggtgccgataccaaacgcaaccatgcctttccaagtggtatcagcccaaccatttttgcctatacctttgccatcgccgccgagccggtgccggataaaagcaaggtcagcacctatagtgtggttaccgccaacgacttacgctggcagcgctgccatattaaatccacctctttgctgggtaatgtgctgcattatcaatacggcgtggaacagggcgcgcaggaaaccctgctatttgaccgcgacggcaacttaaccgaaggcgcggcagtaaatgtatttgtggtaaaaaacggcgaaattgctaccccgccgctaagtaataagctgttacccggtgtcacccgcttactgctgctggcgatcctgcgccaacactcggatttaaaggtggtagagcgtgagattagcttcgacgaagtattggctgccgatgaaatctggctaaccagctccagtaaagaaattgcgccggtagttaaggttaatggccagccggtgggggatggcactgtgggtgatatctggctggcggcgcagcggttgtttagtgagcataagtatagtgttgagtgttag

SEQ ID NO: 882 - protein, 290 aa, Unknown; identical to SEQ ID NO: 76
  Obtained from environmental sample
  DOMAIN (7)...(282): Aminotransferase class IV
  misc_feature (1)..(290): Xaa is any amino acid

SEQ ID NO: 883 - DNA, 878 bp, Unknown
  Obtained from environmental sample
  misc_feature (1)..(878): n is a, c, g, or t
atggtttatctgaacgggcgttttgtccccatggaggaagccgtcgttcccatcgaggaccgcggctaccaatttgctgatggtgtctacgatgttttgaaatttcacgggcgttgcgctgtgcggctgacggcccacctcgaacgtcttgcggaaagctgcgcggggttgcgcattgaaggcgtgccttcggcccaggggtggcgctccatcatcgcggagttggccgagcgcagcgaacttggccacacgtttgacgacactgtcattctctacattcaggttacgcgaggagtggcttcgcgcattcactatttccccgagccgcgccccaagcccacggtcctggcctatttcaaagcggctcccgtttaccccgaggcattgcgtcgcgacggggcctcagtgatcacgatgcccgatgagcgctggggtcgctgtcacatcaagagcattgcccttttgcctgtcgtcctggccaagcaagcggcgcgcgaggccggtgctctcgaggcgcttctcgtgcgcgacgggatcgtgactgagggcggcgcgtcgaatgccttctgtgtgcgccagggagtcatcttcacgcacccggagggcccccgcattctctcaggggtcacgcgcggcattgttctcgatgcagcacgacgccttggcattgaggtgcgtgaggagcccgttcccatcgaagagttccgtgcggcggacgaggcgtttctttcgagcacaaccatgaacgtcatgcctgtgacgcgtatcaatggcgctcccgtcggaagcggagctgttggggaagtcacgcgctccatcgcggcggcggtcgaagaactcattcgggaggagcatgaagccaacgcgtccctcggata

SEQ ID NO: 884 - protein, 292 aa, Unknown; identical to SEQ ID NO: 88
  Obtained from environmental sample
  DOMAIN (5)...(278): Aminotransferase class IV
  misc_feature (1)..(292): Xaa is any amino acid

SEQ ID NO: 885 - DNA, 861 bp, Unknown; identical to SEQ ID NO: 19
  Obtained from environmental sample
  misc_feature (1)..(861): n is a, c, g, or t

SEQ ID NO: 886 - protein, 286 aa, Unknown; identical to SEQ ID NO: 20
  Obtained from environmental sample
  DOMAIN (8)...(270): Aminotransferase class IV
  misc_feature (1)..(286): Xaa is any amino acid

SEQ ID NO: 887 - DNA, 801 bp, Unknown
  Obtained from environmental sample
  misc_feature (1)..(801): n is a, c, g, or t
atgggtgcaagcgagacgctggcgtcgatcgacggccagatcgtgccgctcgatcaggcgacgatcctgatcaccgatcagggcctgatccgtggcgacggggcgttcgaagtcgtgcggctcttcgacggtgtgccgttcgcgctggaccagcatttcgagcgcctgcaacgctccgccgaaaacctgctgctcccagtggacgtggagctggtgcacagcgaggcgctggcgctgctggcggccagtaacgccgcgggtgtggagcatcagctgatgcggatcatgctgacccgtggcgggcgacggatcgtgctgaccgagccgatgccgttcgagcccgaggaggcgcgcctgaagacgatcacctaccagccgaccctcgtgctggacggcgtcaagtcgctctcgtatgccgcgaacatgctcgccacccggcgggcggtggcggcgggctacgacgaggcgctgctggtgacgcccgcgggccgggtgctggaagccccgaccgcgtcgctgttctgggtgaagaacggtgagctgcgcacgccgccgctgagcgatcacatcctcgcctcgatcacccgcggcctgctgctggagctcacctccgcggtcgagtacccgacggcgctcccggagctgctcgaggcggatgaggtgttcctcgcctcgaccacccgtgaggtccagccggtctgcgagatcgacgggcgccgcttcctcaccggcggcccggtcgcgagcgcgaccgatcagacggtccaggcccacctcgcggagctgctcgcgcgggcgtag

SEQ ID NO: 888 - protein, 266 aa, Unknown; identical to SEQ ID NO: 28
  Obtained from environmental sample
  DOMAIN (11)...(256): Aminotransferase class IV
  misc_feature (1)..(266): Xaa is any amino acid

SEQ ID NO: 889 - DNA, 840 bp, Unknown
  Obtained from environmental sample
  misc_feature (1)..(840): n is a, c, g, or t
atgcagaaggtttttttaaacggtgaatacctgcccttgccggaagccaaggtttcggttctggatcgcggttttttgtttggcgatggcgtttacgaagttattccggtctatgcggggcatttattcaggatggccgaccatatcgagcggttgaacaatagcctggcgggtatacgtctgcctttggattatagcgtcgacgactggcgggcgatttttgcgcctttgttggacggcggcaaggatcaatatatctatttacaaattacccgcggctatgcgccgaaacgcgatcacgcttttcctgaacaagtcataccgactatttttgccatgtgttcggatattacgcctttcccggaaaaatttaccggcatcaaagccgtctccgtggacgatatccgctggcaactatgccatatcaaggccattaccttgctggccaacattctgttgcggcaacaggccgtcgagcagggcggtgccgaggctattctggtaaaaaacggctatgttatcgaaggagctgcgagtaacgtttttaccgtgatcgatggggtattgattaccccgccaaagtcgaatgagattctgcccggtatcacccgcgatgttgtcctgaagctggcgcaagcccatggcttgccgttccgggaagatattatcgccttggaagcgttacgctccgccgacgaaatttgggtcgccagttccatccgggaaattctgccggtcgtggaattggacggagtagccgtagccggcggcaaacccggagcgatatggcgcgacatggataactatttgcaagcctataagaaatcctgtcatgactag

SEQ ID NO: 890 - protein, 279 aa, Unknown; identical to SEQ ID NO: 26
  Obtained from environmental sample
  DOMAIN (7)...(271): Aminotransferase class IV
  misc_feature (1)..(279): Xaa is any amino acid

SEQ ID NO: 891 - DNA, 861 bp, Unknown; identical to SEQ ID NO: 21
  Obtained from environmental sample
  misc_feature (1)..(861): n is a, c, g, or t

SEQ ID NO: 892 - protein, 286 aa, Unknown; identical to SEQ ID NO: 22
  Obtained from environmental sample
  DOMAIN (8)...(270): Aminotransferase class IV
  misc_feature (1)..(286): Xaa is any amino acid

SEQ ID NO: 893 - DNA, 861 bp, Unknown; identical to SEQ ID NO: 23
  Obtained from environmental sample
  misc_feature (1)..(861): n is a, c, g, or t

SEQ ID NO: 894 - protein, 286 aa, Unknown; identical to SEQ ID NO: 24
  Obtained from environmental sample
  DOMAIN (8)...(270): Aminotransferase class IV
  misc_feature (1)..(286): Xaa is any amino acid

SEQ ID NO: 895 - DNA, 849 bp, Unknown
  Obtained from environmental sample
  misc_feature (1)..(849): n is a, c, g, or t
atgaaagagctgggctattacaacggaaaaatcggggaattaagcgaaatgaccgtgcccatgaatgaccgggcctgctggtttggggacggggtctatgaggccggcatgtgccgggatgggcagatcttcgccctggatgagcatgtggatcggctctttcgcagcgcggccatgctggaaatccgggttcccgtttccaaagaggagctgaagcagctgttatatgatcttatcggaaagatggataccggcgatctcctggtgtattatcaggtcacccggggctgcggtccccggggccacgccttccccgatggtcccgccagcctgtgggtcaccctgcggccgaaaaccctgaatccctttctgcctcccgtctccctgatcacggatccggatacccgctttttccattgcaatatcaagaccctgaacctgatcccctcggtcatggcgaatgagaaggccaggcgggccggctgttacgagtgcgtgctgtatcggcccggcggccgggtcacggaatgctcccacagcaatgtgcatatcatccgggacggcgtcttcatcaccgccccgacggatgagctcatcctgcctgggatcgcccgggcccatctgatcagggcttgttccgcgctggggatccccgtccgggaaactcccttcaccgtggaggatctgaaagccgccgacgagatcctgacctccagctccaccgcgccctgcatccgcgcctgccgggtcgacgggcaggcagccggtatgcggcggccggatctgtttgatgcgctgcatcgggcggtttttgatgagtattttggaaatcaggggtggaggtcatag

SEQ ID NO: 896 - protein, 282 aa, Unknown; identical to SEQ ID NO: 30
  Obtained from environmental sample
  DOMAIN (8)...(271): Aminotransferase class IV
  misc_feature (1)..(282): Xaa is any amino acid

SEQ ID NO: 897 - DNA, 1353 bp, Unknown
  Obtained from environmental sample
  misc_feature (1)..(1353): n is a, c, g, or t
atgagcatcctcagcacctacgaagcgaagcaccccacctcggccgagctgcaccggcaggcgcaggggatattcccggacggcgtcacgcacgatgcccgctacttcacgcccttcccgatctacgcggagcggtcgcagggcagccacaagtgggacgtggacgggaacgagtacatcgactacgtctccggtcatggcgccctgctgctcggccacggtcgggcagaggtgacgcaggctgtggcacaacagatcgcgcggggcacgcacctcggggcatcgacgccgctggagatcgagtggggtcgctgggttcagcggttgatcccgagcgcggaacgggtgcgtttcaccagttcgggtaccgaagccgtgcaaatggctgtgcggctggcccgggccttcaccggccgcgacctgctgatcaagttcgagggacatttcaacggctggagcgacaccgtctccgccaacctgctcgcgggccacgacggtcccgcctgcgtcggcgtgcctgacgcggccaccggcctccaactgatcctccctcagaacgacatcccggccttcaccctggcgatggaggagcacgcgggcagggtcgccgccgtgatcctggagccgacgggcgcctcgatgggtggaatcccgatcgagccggagttcctcttcgccctccgggagcagacggagcgcaccggcacgctcctgatcttcgacgaggtcgtgaccggcttccggatcgcgccgggcggtacgcaggcgtacttcggcatcacgccggacctgaccacactcgccaagatcctggcgggaggtctgcccggcggcgccgtcggcggacgagcggagattctgggccagattgagttcaacccggagcactccccagcgggccgtatcgcccaccctggcacgttcaacgcgaacccgctctccgctgcggcgggcgcggcggcgctggcgatcgtcgccacgggcgagccgcaccggcgggcgaacgccgccgccgccaccctggcgcgggagatgaacgatgccctcgcgcggcgggagatcgacggctgcgtctacggcctcggctcgctgctgcacatcctgctgggcaagccgtgcgctcgtcccgaggacgggctgacctgggtctgggagggagagcaccgctcggccgtgccgcgtacgtcgccggagctggtcacggccttccgccgcggcatgctcaaccacggcgtcgatccgatggccacccggttgatcgtcggcgcggagcactcggacagcgacgtggccgccacgatcaccgcgttcgaggcgacgctggacgagatgcgggaggagcagttcctgtaa

SEQ ID NO: 898 - protein, 450 aa, Unknown; identical to SEQ ID NO: 50
  Obtained from environmental sample
  DOMAIN (42)...(371): Aminotransferase class-III
  misc_feature (1)..(450): Xaa is any amino acid

SEQ ID NO: 899 - DNA, 1362 bp, Unknown; identical to SEQ ID NO: 127
  Obtained from environmental sample
  misc_feature (1)..(1362): n is a, c, g, or t

SEQ ID NO: 900 - protein, 453 aa, Unknown; identical to SEQ ID NO: 128
  Obtained from environmental sample
  DOMAIN (64)...(440): Aminotransferase class I and II
  misc_feature (1)..(453): Xaa is any amino acid

SEQ ID NO: 901 - DNA, 1386 bp, Unknown
  Obtained from environmental sample
  misc_feature (1)..(1386): n is a, c, g, or t
atgcctgacaccaacctgacgaactcgaagatcgtcgcggcctatcgcgagcgcacaccgggctcagcgagccttgcggccaaggcgcaggagctgctgccgagcggcatcgcccacgacgcccgcttcatgaagccctacggcatctatgtcgagcgagccaagggcccgcgcaaatgggacgtggacggcaacgagtacgtcgactatttcggcggacacggcgcgttgctcctcgggcacaaccatccgagcgttgtggccgcgagccacgcggcgctcgagcaaggcacgcatttcggcgccaatcatccgcgcgaggtccgctgggccgaactggtgcgcaagctggtcccctcggcggagagcgtgcgcttcacctcgtccgggaccgaggccacgttgatggcggtgcggctttcgcgctcggtcaccggcaagcccaaagtcgtgcgcttcctgacgcatttccacggctggcacgaccacatgacctcgggccacgccaaccatttcgacggcacgccgacggcgggcgtgctggccggcgtcgccgagcacgtgatcctgctgccgcctggcgacgtcgaagcggtaaagagcacgttcgccagccgcaacgacatcgcctgcgtgatcctggagccgaccggcacgagcttcggcgcggcgccgctgccgccgtccttcctccgcgtcctgcgcgaggagaccgagaagcacgggatcttcctgatcttcgacgaggtggtgacgggatttcgcgtctcgcccggcggcgcgcaaggcgagttcggcatcaagcccgacctgacgtcgctcgccaagatcctggcgggcggattgcccggcggcgcggtcgtgggccggcgcgacattctggacgacctcgacttcgacgcggtcgagcgcaagaagcgcgagaagatcgcgcaccccggcacctacaatgctaatccgctatccgccgccgccggcatcgccgcgctggagatcgtcggcaccggcgagccctgcaagcgggccagcgccacggccgcctcgctccgcgcggcgctcaacgacgtactggcggaggagcgcgtaccttgggcggtctacggctccttcagcggattccatttcttcctgaatgcgaagcagcgggcggtcgacccgttgcgcttcgatccgatgacgctcgactacaaagagctgctgagcaatccacccgcgctcgcgcgcttgctgcgcctggcgctcctcgccaacggcgtcgacgtcaacggccgggcaagcggcttcacctccgcggcgcatgggcctgcggagatcgaggaaaccgcccgtgcgctccgccagagtctccgcatgctgcgcgccgagggcgagctgccggctcgatag

SEQ ID NO: 902 - protein, 461 aa, Unknown; identical to SEQ ID NO: 138
  Obtained from environmental sample
  DOMAIN (5)...(363): Beta-eliminating lyase
  misc_feature (1)..(461): Xaa is any amino acid

SEQ ID NO: 903 - DNA, 1383 bp, Unknown
  Obtained from environmental sample
  misc_feature (1)..(1383): n is a, c, g, or t
atgccggatacgctgacgacaaactcgccgatcatctccgcctaccgcgccgcgacacccggctcggccgagcacgcgcaacgcgccgccgagatgttcccctccggcatcacccacgattcgcgctacatcgagccctacgggatctacattgcgcgcgcccaggggccgcgcaaatgggatgtcgacgggcgctgctatgtcgattatttcggcggccatggtgcgctgctgctcggccattgccatcccgaagtgatggcggcggtacacgcccaactcgaccgcgggacccattacggcgccagccacgagctggagatcgaatgggccgagcgggtcaaggcgctgatcccgaccgccgagcgcgtgcgtttcacctcatcgggcaccgaggcgacgctgatggcggtgcgcctcgcgcgcgccttcaccggcaagccgaagctgatccgcttcaactaccatttccacggctggcacgaccacatgacgtccggccacgcgaaccatttcgacgggacgccgacgaccggcgtgctcgacgcggtggccggcaacgtccttctgtgcgaccagaatgacgaggcggcgctggcgcggctgctcgaccggcatcacggcgagatcgccgcggcgatcatcgagccgactggcgccaacggcggcaaattgccgatcgacccggatttcctccaggcgctgcgccggctcaccagcgagcatggcgtgctgttgatctttgacgaggtggtgaacggtttccgggtcgcgccaggcggcgcgcaggaggcctacggcatccggcccgatctcacaaccctggcgaaaatcctcgccggcggactgccgggcggcgccgtaaccggcagaaaggacatcctcgacctcctcgacttccaggttaccaaaggcgccggcaaggagaagatcaaccatcccggcacattcaacgccaacccgctgtcggccgccgccgggattgccgccctcaagatcgtgcgcgagagcgacgcctgcgcccgcgccaaccattacggcgacgagctgcgccgccggctcaacgaggtgtttgaggaggagcggatgccgtgggccgcgtacggcaccttctcgacccttgaattgttcaccaaccccgagggcaaaaagatctcgccgagcaccttcgatccgctagaggaatcgttcgccagcctcaaaggcgagcgcaacgccggcatcatccacaagctgcgcctcggcatgatgatccacggcgtcgacttgtcgagccatccgggcggcgtcatctcgtgcacgcacggcgaagccgagatggaggacaccgtcaaggcgatgcgaagcaccgtgcgcatgctgcgcgccgagggtgagctgtag

SEQ ID NO: 904 - protein, 460 aa, Unknown; identical to SEQ ID NO: 140
  Obtained from environmental sample
  DOMAIN (50)...(378): Aminotransferase class-III
  misc_feature (1)..(460): Xaa is any amino acid

SEQ ID NO: 905 - DNA, 864 bp, Unknown
  Obtained from environmental sample
  misc_feature (1)..(864): n is a, c, g, or t
atgcgtaccgtctatgtgaatggcaaatttctgcccgaggccgagggtatggtttcgatcttcgatcgcggcttcaccatgagcgacagtgtctacgaagtgaccggcgtcgtcgccggcaagatgctcgacttcgaccctcatatggcccgcctgcagcgctccatgagcgagctcggcatgccaaaaggccccggggccgatgccttaaaggcaattcatctgaagatgatcgagctgaacaaactcgacgaaggcctggtctatctccagattacccgcggggtgcaggaccgcaatttcgagcttcccgcagcagacaaccccttgaccatcgtgctgttcacccaggcgcgcccggtggtggaatctgcgcaggccgagcgcggcatcaaggtcatcagcctgccggatctgcgctggcaccgcagcgacatcaagacgacgcagctcctctatgcctgccttgccaaggacgcagcgaagaagcggggctgcgacgatgcctggctggtgcgcgacggtctggtgaccgagggcagcgccaacaatgccttcattgtcacgcgggacggacttgtcatcacgcgtgacctttccaccgagcttcttcccggcattacccgcaagcggatcgtcgagctggcggcaaatcacggctatcgcctcgaacaacgtgccttcaccattgccgaggcgaaggccgcggtcgaagccttcatcacctcggcaacgcagttcgtcatgccggtggtggaaatcgacggcgcggcaattggccagggcaagccaggcaaattcagtgttgcacttcgcaagctttacatcgaagaaacgctgtcgcgcgccgggatcaggcgatag

SEQ ID NO: 906 - protein, 287 aa, Unknown; identical to SEQ ID NO: 130
  Obtained from environmental sample
  DOMAIN (7)...(276): Aminotransferase class IV
  misc_feature (1)..(287): Xaa is any amino acid

SEQ ID NO: 907 - DNA, 831 bp, Unknown
  Obtained from environmental sample
  misc_feature (1)..(831): n is a, c, g, or t
atggctgctgacgtggtctggctcaacggggccgtcgtgcccgccgccgaggcgacggtctccatcttcgaccacggcctcacggtgggcgacggcgtgttcgagacgctcaaggcgaccgccggggtgcccttcgcggcgcgccgccacctcgagcggctccggcgctccgccgacgggttggggctgaaggtgccgtggaccgacgacgacctgcgggccgcgatggaggccgtgctggccgggctcgacctgcccctggcccgggtccgcatcaccgtcaccggcggcgccgcccccctcggctccgatcgcggggacgggccgcccacggtcgtcgtggccggcgggccgctggcccggcccgcgcccaccaccgacgtctgcacggtgccgtggccccgcaacgagcgcggcgccctcgccggcctcaagaccacctcctacgccgagaacgtccgggccctggccgtcgccaaggagcagggctgcaccgaggcgctctacgccacgacgacgggcctcctctgcgagggcaccggcgccaacctcttcctcgtccacgagggccgcctcgtcacgccgacgctcgccagcggctgcctggccggggtcacccgcgccctggtcctggaggtcaccgacgccgtcgaggtcgacctgccggcggaggcgctggctggcgccagcgaggcgttcctcacgtcgacgggccgtgacgtgcaggccatcgcgcacgtcgacggccgcgcctacgacgcgccgggcccgcagacggccgcggccgcgaaggccctcgccgcgctggaggccagcaaccccgacccctag

SEQ ID NO: 908 - protein, 276 aa, Unknown; identical to SEQ ID NO: 126
  Obtained from environmental sample
  SIGNAL (1)...(18)
  DOMAIN (9)...(267): Aminotransferase class IV
  misc_feature (1)..(276): Xaa is any amino acid

SEQ ID NO: 909 - DNA, 855 bp, Unknown
  Obtained from environmental sample
  misc_feature (1)..(855): n is a, c, g, or t
atggcttattcattatggaatgatcaaattgtggaagaaggatccattgcggtatcaccagaagatagaggctatcaatttggtgacggcatttatgaagtaatcaaagtttataacggaaatatgtttacagcacaagagcatattgatcgtttctatgcaagcgccgaaaaaattcgtcttgttattccttatacaaaagacgttttacacaaattattacatgagctaattgaaaaaaataatctagatacagggcatgtttatttccaaatcacacgtggtgccaattcacgtaatcacgttttcccagatgcaagtgttccagctgtattaacaggtaatgtaaaagcgggtgaacgtgcatatgagaactttgaaaaaggggtaaaggctacgtttgtagaggatattcgttggttacgctgtgatattaaatcgttaaacttacttggtgcagtattagcaaaacaagaggctgctgaaaagggctgctatgaagcgattttacatcgtggggatatcgtaacagaatgctcatcagcaaatgtttatgggattaaagacggtaagctttatacacatccagcaaataacttcattttaaacggtattactcgtcaagtgattttgaaatgtgcagaggagattagtttacctgtcgtggaagaaccaatgacaaaagctgatttattaacaatggatgaaatcattgtatcatctgtatcttctgaagttacacctgttattgatgtggatggtaaccaaattggtgcaggagtgccaggtgaatggacgcgtaaattgcaacaagcttttgaggcgaaattaccactttctttgaatacaaaataa

SEQ ID NO: 910 - protein, 284 aa, Unknown; identical to SEQ ID NO: 132
  Obtained from environmental sample
  DOMAIN (7)...(274): Aminotransferase class IV
  misc_feature (1)..(284): Xaa is any amino acid

SEQ ID NO: 911 - DNA, 876 bp, Unknown
  Obtained from environmental sample
  misc_feature (1)..(876): n is a, c, g, or t
atgagcggaccgctcccgatctgctacctgaacggcgagttcttgccgttgcgcgacgcccgtgtatcgcccttggaccgcgccttcctgttcggcgatgcggtgtacgaggtggtgccggtctacgatgcgcgcccgttccggctgcgccagcacctggagcgcctcgaccgcagcctcgccggcatccgcatgccgccggccctgccgcacggcgactgggcacacatctgccaggagctgatccgccgcaacgacgccgacgaggcctacgtatacatgcaggtgagccgcggtgcggagtatggccgcaatcacgcctggcccgaggacttgaagcccaccctgttcgcctatatttcggcgatggacgggctctcgaacgccctcatcgagaagggcgtggccgcggtgaccgccaaggaaatccgctgggcgcgtcgcgacatcaagtcgaccgcgctattgggcaatattctcttgaagaagctggcgcaggagcgcggcgccttcgagaccatcatgctggagaacggcgaattgaccgagggctcatccaccaccgtgcacgtgatcaagaacggcatcattcacacgccgccgaacggccagaagatactgcccggcaccacgcgcgatgtggtgaccgagcttgccgggttgctgtccatcccctgcaagagcgcgccggtgagcgaagcggagctgcgcgcagcggacgagatctggctcgcctttgccacccgcggggtgcttgccgtgacggcgcttgacggcgagccggtgggcggcggcaaaccgggtccgctgttcgctcgcatgcgactcgcgttcgccaactatgcacgcgacctcaagggcagtccggcgctatag

SEQ ID NO: 912 - protein, 291 aa, Unknown; identical to SEQ ID NO: 134
  Obtained from environmental sample
  DOMAIN (11)...(279): Aminotransferase class IV
  misc_feature (1)..(291): Xaa is any amino acid

SEQ ID NO: 913 - DNA, 852 bp, Unknown; identical to SEQ ID NO: 151
  Obtained from environmental sample
  misc_feature (1)..(852): n is a, c, g, or t

SEQ ID NO: 914 - protein, 283 aa, Unknown; identical to SEQ ID NO: 152
  Obtained from environmental sample
  DOMAIN (8)...(275): Aminotransferase class IV
  misc_feature (1)..(283): Xaa is any amino acid

SEQ ID NO: 915 - DNA, 1383 bp, Unknown; identical to SEQ ID NO: 147
  Obtained from environmental sample
  misc_feature (1)..(1383): n is a, c, g, or t

SEQ ID NO: 916 - protein, 460 aa, Unknown; identical to SEQ ID NO: 148
  Obtained from environmental sample
  DOMAIN (49)...(375): Aminotransferase class-III
  misc_feature (1)..(460): Xaa is any amino acid

SEQ ID NO: 917 - DNA, 915 bp, Unknown
  Obtained from environmental sample
  misc_feature (1)..(915): n is a, c, g, or t
atgaaaggaaatactaatgccgacctttcctcagtggatctgcccggggcaggttctacagccgtgtatcctaccaaggtatttctgaatggcagcatagtcgatgctgaaaacgcaaaggtttccgtctttgatcggggttttatctttggcgacgggatctatgaagtaatggcccggatcaatggcgttttcttctatggcgatgcccattgggaacgattggaaacctgcctgcagaagatcggcctggtctacgacatatcaattctaaaggacgcgatcccggaattgctggaagcatccggaataggtcaggaagattgtatggtctatatccaggtaaccaggggaacggcccccaggcagcatggctaccctcccagcccccaacccactgcaatgatgtacgcctggaagaagaccctcccggccattgaaacaaagcattcccgtgtagttaccctggaggattttcgttggtctcgctgcgatattaaaatgacgtccctcttgggcaatgtcatggcaaacgaatgggccatggagaacgaggcctacgaaaccgtcctgatccgaaatggcgtagccacagaggcatcccactgtaatgttttcttcgtgaaggacggtacggtatggacccaccctgcggaccatcatatcctcgacgggatcacacgccaggtagtcctggaaatttgtgaggagctcggcatcccggttagacttgagggtataccggcggataaattgaaacaaatggacgaggccttccttacgggcaccggatcacaggtacgggccatacaggagctcgacgaccatccgtattttaaaacccatccgggtcctgtaacccttcggatacaacgcacattcctagaacttaaaagcggaaagatctcgttctag

SEQ ID NO: 918 - protein, 304 aa, Unknown; identical to SEQ ID NO: 144
  Obtained from environmental sample
  DOMAIN (30)...(295): Aminotransferase class IV
  misc_feature (1)..(304): Xaa is any amino acid

SEQ ID NO: 919 - DNA, 1350 bp, Unknown
  Obtained from environmental sample
  misc_feature (1)..(1350): n is a, c, g, or t
atggctctcgaacaggtctatcgtcaagcgcttccggcctcgcacgccctctttgagcgcgcccaaaaccttttccccgacggggtcacccacgacaaccgccggatgcagccttttcccatctttgtcgaacgtgccgatggggcgtacaaatgggatgccgatggccggcagtatatcgactactggatgggccatggtgcactcattatggggcataaccctccgcacgtgcgcgatgccgtcatcgagcaagcggcgcgtggcacgcactacggcgccagtcatgctctcgaagtggtatgggccgaatgggtctgtaagctggtgccctgtgctgagcgcgtgcgctttacggcctcgggcactgaggcgacgcacatggccctgcgtctggcccgcgcctatacgggcaagcggcgcgtgatcaaattcgccgggcactttcacggctggcatgagggcctggaagtgggtgtacagaccccctatgaaacagtgccagagccagggcaaatgcaagaagcggtagacgccgtcgccctgtgcccaccgaacgacattgaggccgtccgggctgcccttgccgctggtgacgtggccgctattatcctcgaacccacgggtggccactttggcacggtgccggtggcgccgggttttttacggtgtctacgggaagaagccaccagggctggggtggtgctcatcttcgacgaagtagtgacgggttttcgtgttgcgccaggcggtgcacaggaactctacggcgtcactcctgacctttcgacgtttgctaaaattctcgctggcggtctgcctggtggggctgttgctggccgggccgagatttttaactatctggcgacgccaacagccgctgagataggaaaacgtgcaaagattcaccatcccggcacgttcaacgccaatcccctctcggccgcggccggcgtggcgatgctgtcctctctggccgatggcacatgcatcaagcgcgccaacgagcaggctgccaagctacggcatggtatgaacgacatcctcgcacgcgaaaaagtcgcctggaaagtctatggccagcacagcgactggaaactgttctacggcgctggtgccccaccgcgtgatggcgctgaccagtccgtggatgacatcccctggcagcgcctggacggcaaattcccgcagcagagccgggccatgcggcaagcgctcatcctgcaaggtattgactttaacggggcgcgtgctctcgtaggtacctgccacactgacgacgtcgtcgctgagaccctggcgggctttgcagaggcggtacgggccgtcaaagccgacgggctcgcgtag

SEQ ID NO: 920 - protein, 449 aa, Unknown; identical to SEQ ID NO: 146
  Obtained from environmental sample
  DOMAIN (42)...(355): Aminotransferase class-III
  misc_feature (1)..(449): Xaa is any amino acid

SEQ ID NO: 921 - DNA, 1377 bp, Unknown
  Obtained from environmental sample
  misc_feature (1)..(1377): n is a, c, g, or t
atgagcgtgcactcggtcactgagctccatgcagcctatgccgcgaaatttccccgatcggcggcctcggcccgcgccgcgaacgaggccatcgccggtggcgtggcgcatgatgggcgtgctgcctcgccgttcccgctctttatcgacagcgcccagggcgcgcgcaagcgcagcgtcgatgggcacgacctgatcgatttctggatgggccatggcgcgttgatgctgggccaccgccatcccgcgatcgaggcggccgtggcccagcagcttgcccggggaacgcactttggcgccagccacgaggccgaggtgcagtgggcgcagaagatcatcgaactggtcccttcggccgagctggtgcgcttcgtggcgtcgggaacggaagcgacgcacatggcgctgcgcctggcgcgggcagccacgggccgctcacgcatctgtcgcttcgaggggcatttccacggctggcacgactgggtcgccctggggaaccgtgcgcccttcgaccaaccaagctccggggggattgctccggcggtgcgcgacgagatcacggttctgcccaacaacgatgccaacgcgttgcgcgcggcgctggcggctggtgatgtggccgccgtcatcctcgaacctgggggcggcacgcagggacgggttcctctctgttcggaatttctctgtgaagtacgagacctgacgtcgcggcaggggacggttctgatcttcgacgaggtggtgacggggtttcgcatcgcgccgggtggtgtgcaggagcggagtggcgtcgtgcctgacctgacgaccctggccaagatcgtggctggcgggctgccgggtggggccgtttgcggcaagcgggaggtgatggatgtcctctcctttgcgccgcctgctggcgtgacgcgcgtggcgcaccccggaacgttcaatgccaatccgctcagtgccgccgctggcatcgcgatgctggaggaggtcgccgatggtggcccgctggacgatgccgccgcgagtgcggccatcctgcggcgcggcatcaacgatctcctggccgcgcgcggcatcgctggctttgcctatggcgatcgttccatcgtgcacatcctgctcgggccggccggacggcgagcgcgggcggctgacggtaatcttgacaccatccccgccgccgagttgctggcggccgatccggtcgtggcgaaagccttgcgcaccgcctgcctctttcacgggctggatctgatggggccgacgatgatggtcgcgagcgtccacgatgccgccgcgatcgacgaggcgctgacgaggttcgagcgggtgttcgccacgctgatggcgcttgacgagtgccaaccgattttggaggcctag

SEQ ID NO: 922 - protein, 458 aa, Unknown; identical to SEQ ID NO: 164
  Obtained from environmental sample
  DOMAIN (48)...(364): Aminotransferase class-III
  misc_feature (1)..(458): Xaa is any amino acid

SEQ ID NO: 923 - DNA, 861 bp, Unknown; identical to SEQ ID NO: 161
  Obtained from environmental sample
  misc_feature (1)..(861): n is a, c, g, or t

SEQ ID NO: 924 - protein, 286 aa, Unknown; identical to SEQ ID NO: 162
  Obtained from environmental sample
  DOMAIN (8)...(278): Aminotransferase class IV
  misc_feature (1)..(286): Xaa is any amino acid

SEQ ID NO: 925 - DNA, 1377 bp, Unknown; identical to SEQ ID NO: 149
  Obtained from environmental sample
  misc_feature (1)..(1377): n is a, c, g, or t

SEQ ID NO: 926 - protein, 458 aa, Unknown; identical to SEQ ID NO: 150
  Obtained from environmental sample
  DOMAIN (49)...(367): Aminotransferase class-III
  misc_feature (1)..(458): Xaa is any amino acid

SEQ ID NO: 927 - DNA, 1185 bp, Unknown
  Obtained from environmental sample
  misc_feature (1)..(1185): n is a, c, g, or t
atgagaaaaggacttgcaagtagggtaagtcacctaaaaccttcccccacgctgaccataaccgcaaaagcaaaagaattaagggctaaaggagtggacgttataggttttggagcgggagaacctgacttcgacacacccgacttcataaaggaagcctgtataagggctttaagggaaggaaagaccaagtacgctccctccgcgggaataccagagctcagagaagctatagctgaaaaactactgaaagaaaacaaagttgagtacaaaccttcagagatagtcgtttccgcaggagcgaaaatggttctcttcctcatattcatggctatactggacgaaggagacgaggttttactacctagcccttactgggtaacttaccccgaacagataaggttcttcggaggggttcccgttgaggttcctctaaagaaagagaaaggatttcaattaagtctggaagatgtgaaagaaaaggttacggagagaacaaaagctatagtcataaactctccgaacaaccccactggtgctgtttacgaagaggaggaacttaagaaaatagcggagttttgcgtggagaggggcattttcataatttccgatgagtgctatgagtacttcgtttacggtgatgcaaaatttgttagccctgcctctttctcggatgaagtaaagaacataaccttcacggtaaacgccttttcgaagagctattccatgactggttggcgaataggttatgtagcgtgccccgaagagtacgcaaaagtgatagcgagtcttaacagccagagtgtttccaacgtcactacctttgcccagtatggagctcttgaggccttgaaaaatccaaagtctaaagattttgtaaacgaaatgagaaatgcttttgaaaggagaagggatacggctgtagaagagctttctaaaattccaggtatggatgtggtaaaacccgaaggtgccttttacatatttccggacttctccgcttacgctgagaaactgggtggtgatgtgaaactctcggagttccttctggaaaaggctaaggttgcggtggttcccggttcggccttcggagctcccggatttttgaggctttcttacgccctttccgaggaaagactcgttgagggtataaggagaataaagaaagcccttgaagagatctaa

SEQ ID NO: 928 - protein, 394 aa, Unknown
  Obtained from environmental sample
  DOMAIN (32)...(387): Aminotransferase class I and II
  misc_feature (1)..(394): Xaa is any amino acid
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 929 - DNA, 969 bp, Unknown
  Obtained from environmental sample
  misc_feature (1)..(969): n is a, c, g, or t
atgagcatgtccttcatggaaaccgtattttcaggtcacgcagaacgtgtcgccgcgctagaagcaagcgacagcgctttcgccaagggcgtggcgtgggtcgatggcgaacttgttccgcttcacgaggcccgcattccgcttctcgatcagggtttcctgcactccgatctgacctatgacgtccccgccgtctgggatggcaggttttttcgccttgatgaccatctcgatcgatttgaggcgagctgcgcgaaactgaagctgaaaagcccgatggatcgcgaaaccatgaaggcaacgcttgtcgagatggtcgccaaaagcggcattcgtgatgcctatgtggaaatgattgtcacgcgtggcctgaaattcgtacgcggcaacaaacccgaggacatcgtaaattcgctttacatgctggtcatgccctatgtgtgggtgatgtcaccggagatacagcgtgttggcggcagtgctgtcatcacccgcacggtgcgccgtgttccgccgggcgccatcaacccaacgatcaagaatctgcaatggggtgatttcgtgcgcggtctgatggaagcgcaggatcgcggcgccatttacccgatccttcccgatggtgacggtaacatcaccgaaggctccggtttcaatgtgttcctggtcaagaatggcgtgctttacacaccggaccgtggcgttctggaaggtgtgacgcgaaaaaccgtgttcgatatcgccgctgccaagggctggaaggttgcccttgaacatgtgccggttgaacttgcctatcatgccgacgaaatatttttctgcacgacggcgggcggcatcatgccggtcacaacattggatggagaacttgttggcggcggacaggttggcccggtcacccgcgcgatctgggacgaatattggaagctgcattacacagcagatttgagttttgcgatcgactatccctga

SEQ ID NO: 930 - protein, 322 aa, Unknown
  Obtained from environmental sample
  DOMAIN (35)...(307): Aminotransferase class IV
  misc_feature (1)..(322): Xaa is any amino acid
MSMSFMETVFSGHAERVAALEASDSAFAKGVAWVDGELVPLHEARIPLLDQGFLHSDLTYDVPAVWDGRFFRLDDHLDRFEASCAKLKLKSPMDRETMKATLVEMVAKSGIRDAYVEMIVTRGLKFVRGNKPEDIVNSLYMLVMPYVWVMSPEIQRVGGSAVITRTVRRVPPGAINPTIKNLQWGDFVRGLMEAQDRGAIYPILPDGDGNITEGSGFNVFLVKNGVLYTPDRGVLEGVTRKTVFDIAAAKGWKVALEHVPVELAYHADEIFFCTTAGGIMPVTTLDGELVGGGQVGPVTRAIWDEYWKLHYTADLSFAIDYP

SEQ ID NO: 931 - DNA, 1560 bp, Unknown
  Obtained from environmental sample
  misc_feature (1)..(1560): n is a, c, g, or t
atgtttgcggcggaggtcctgcctctgccgcccgggttccgcgccattgcggaaaagcctgaacgaggaaaaaagaccatgggcacgcagctctcaaactctcttgtccatgcggacatctcgaccacccttcatccctacaccgacgcccgtgcgcatgaaaagcagggcccgatgatcatcgagcgcggcaagggcatctacatctatgacgacgccggcaaggaatatatcgaaggtctcgccggtctctggtcggtcgccgtcggttttgacgagccgcgccttgtaaaggctgccgccgaccagatggccaagctgccctactatcataccttcagccacaagtcgcacgagccctccatccggctggccgagaagatcgtggaaatgacgcccgagcagctgacgcgcgtcttcttcaccagctcgggatcggaagccaacgacaccatgatcaagatggtgtggttcatgaacaatgcgctgggccgcccgcagaagaagaagttcctcgcccgcacccgcggctatcacggtatcacggtggcatccggcagtctcacgggcctgccgaacaatcatcgcgatttcgacctgccggccatcccggtccgtcacctgagctgcccgcaccactatcgcgtcggcctgcccggagaatccgaggcgcagttcgcgcagcgcctgattgccgaggccgaagccgtgatcctcgaagaaggcccggacacgattgccgccttcatcggcgagccgctgatggctgcaggtggtgtcatgcctccgccggccggttactggcagggcatcgaggcgctgtgccgcaagtatgacatcctgcttgtcgccgacgaagtgatctgcggcttcggtcgtctcggaaccgggttcggctgcgaatactacggcttcacaccggacatcatggtcgtctccaagcagctgacctcgtcctatatgccgcttgcggccgttgtcttcagcgaggcggtctacaacgccatcgccgacaacacggccaagatcggcacgttcggccatggcttcaccgcctccggccatccggttgccaccgccgttggtctggaaaacctcaagatcatcgaagagcgcgatctgatcggcaacgccgcccgcatgggcgccattctccaggcacgtctggcggaactggcggatcacccgctggtgggcgaagtgcgcggcgccggcctcatcgccggtctcgagctggtcgccgacaaggaaacgcgccgccccttcgccacggtcggcaaggcgggtgcccgcgcgttcgcagccggacatgagcatggcctcatcgtgcgcgccatcggcgacgtcgtcgcgctctgcccaccgctcatcatcaatgaggagcaggtgaacgaaacggtgaaccgcctgcgcaaggcgctcgacgacacggccaagtggcgtgctgacgagaacctgaacaagggcgagctcaattcgaagcttgaaggtaagcctatccctaaccctctcctcggtctcgattctacgcgtaccggtcatcatcaccatcaccattga

SEQ ID NO: 932 - protein, 519 aa, Unknown
  Obtained from environmental sample
  DOMAIN (60)...(414): Aminotransferase class-III
  misc_feature (1)..(519): Xaa is any amino acid
MFAAEVLPLPPGFRAIAEKPERGKKTMGTQLSNSLVHADISTTLHPYTDARAHEKQGPMIIERGKGIYIYDDAGKEYIEGLAGLWSVAVGFDEPRLVKAAADQMAKLPYYHTFSHKSHEPSIRLAEKIVEMTPEQLTRVFFTSSGSEANDTMIKMVWFMNNALGRPQKKKFLARTRGYHGITVASGSLTGLPNNHRDFDLPAIPVRHLSCPHHYRVGLPGESEAQFAQRLIAEAEAVILEEGPDTIAAFIGEPLMAAGGVMPPPAGYWQGIEALCRKYDILLVADEVICGFGRLGTGFGCEYYGFTPDIMVVSKQLTSSYMPLAAVVFSEAVYNAIADNTAKIGTFGHGFTASGHPVATAVGLENLKIIEERDLIGNAARMGAILQARLAELADHPLVGEVRGAGLIAGLELVADKETRRPFATVGKAGARAFAAGHEHGLIVRAIGDVVALCPPLIINEEQVNETVNRLRKALDDTAKWRADENLNKGELNSKLEGKPIPNPLLGLDSTRTGHHHHHH

SEQ ID NO: 933 - DNA, 1206 bp, Unknown
  Obtained from environmental sample
  misc_feature (1)..(1206): n is a, c, g, or t
atggcgagggtatcgaggaggttccttgaggacagctctagcggcgccaccacaatggcatttgcgcagttggcttccgaggctaaacggaaaccggtgatagacctcaccctaggtcagcccgatgtaacccctccacagactctcgtggagcttctggcgaccgaggctaggggtgtaggagcctcccgctacccgccgccacaaggtctagccgagtatcgcgaggccgtagcatcctacatgcgcgacttttacggtgtcgatgctgagccagagcgtgtcgttgcgcttgcaggtgctaagccgggcatagccgccgccatatactccgtctgtgaccacggcgatgccatgcttgtgctgactccacacttctacgcgtacgtgaacgcggcgcgcatgctaggagtgaagcccgttatggctaggctaaggtgggacggcgggaggcttttcatcgacgaggatgaggtgaagaaggcgtttgaggagcacaagccgtgcctcgttatcgtgaacacaccgcataaccccacgggcctccaccttgatagggagacgctcaagctgataggggatcttgcctcggagcataacacactcgtgctcagcgatgaggtgtactcgtggctcgtgttccgcggtgaacacgtcccgctcctacgcctcctcggcgaagagagagtcatacacctcgagtcgttctcgaagacccttgctatccctggctggcgcgtcggcttcctctacgcgccacgcgaggttgtaaaggcgaccgtcttcttcaattcgaacgtctacactggcatccccaggttcatccagctagccgtagccaagtacatcacagcgtaccgcgaagatatggtcgagtatgtggagagagtgcgtaagctctacgggcggagggcgcgcgtcttcaccgaggccctctcacagctagaggatctcatcgacgtctatgagcccgctgctggcttcttcctattcccgagggtagagcgcctcatagagaagctcggcgtggggagcgcagagaggctcgtagagctgatggccagagaggttggtgtgctggccgtcccgggcaccgtgttcggagaggagtggagaggctacatccgtgttagcctcaccgcgccggagtcaaggcttagggaggcggctgcgaggataggagagctggcaacgcggggggcgtaa

SEQ ID NO: 934 - protein, 401 aa, Unknown
  Obtained from environmental sample
  SIGNAL (1)...(30)
  DOMAIN (31)...(393): Aminotransferase class I and II
  misc_feature (1)..(401): Xaa is any amino acid
MARVSRRFLEDSSSGATTMAFAQLASEAKRKPVIDLTLGQPDVTPPQTLVELLATEARGVGASRYPPPQGLAEYREAVASYMRDFYGVDAEPERVVALAGAKPGIAAAIYSVCDHGDAMLVLTPHFYAYVNAARMLGVKPVMARLRWDGGRLFIDEDEVKKAFEEHKPCLVIVNTPHNPTGLHLDRETLKLIGDLASEHNTLVLSDEVYSWLVFRGEHVPLLRLLGEERVIHLESFSKTLAIPGWRVGFLYAPREVVKATVFFNSNVYTGIPRFIQLAVAKYITAYREDMVEYVERVRKLYGRRARVFTEALSQLEDLIDVYEPAAGFFLFPRVERLIEKLGVGSAERLVELMAREVGVLAVPGTVFGEEWRGYIRVSLTAPESRLREAAARIGELATRGA

SEQ ID NO: 935 - DNA, 1383 bp, Unknown
  Obtained from environmental sample
  misc_feature (1)..(1383): n is a, c, g, or t
atgagcgagcatcgccgcaaccacaatatcgaagaactggtcgagctggacctgcagcatcacctgcatccgttcacggattataagggcctgcgcggcgaaggcggcagccggatcatcacccatgccgagggcgtctatcttttcgacggcaagggcaacaagatcatcgacggcatggccgggctctggtgcgtgaatgtcggttatggccgcaaggaactggccgaggcggcctatcgccagcttctggaacttccttactacaacaccttcttcaagacggcccatccgccctcgatcgagctggcggcgaaggtatcttcgctgttgccggataatttcaattcgatcttcttctccaactctggttcggaggcgaatgacaccaacctgcgcctggtgcaccactattggcgttcagtcggcaagcccggcaaggtgaacatcatcagccgccagaatgcctatcacggctcgaccgtagcgggtgctgcgctgggcggcatgtcgccgatgcaccggcagggcgggcggctcatcccgacgatccatcatgtggcgcagccctattggttcaaggatggcggagatatgacgccggaggaattcggtcgctatgccgcccttcaggtggaagagaagatcaaggagctggggccggagacggtcggcgccttcatcggcgagccgatccagggcgcaggcggggtcattatcccgccggacagctattggcctgagatcaaccggatctgtaaggaatacgatatccttcttatctgtgacgaggtgatttgcggctttggccggacggggaactggttcgggctggaaaccttcgggatcgagccggacctcatcaccatggcgaagggtatgtcgtcgggctatctgccgatttccggctcggccgtgtccgaccgcgtggcggaagggatcgtggaaagcggcggcgaattcttccacggctatacctattccggtcatccggctgcctgtgcggtggcgcttgccaatatcgaaatcatgcagcaggaaaaactggtcgataaggtcaggaacgagaccggcccgtatctggcgcagaaacttgccgaattggcagaccatccgttgatcggtgaggtgcgttcgtccggtcttgtcggcgcgctggagctggtgaaggacaaggaaacccggacccggttcaagcccgacggtaaagcgggcacggtctgtcgggatcatttcttcaagcgcaatgcgatcatgcgcgcctgtggggatacaatggttctgtccccgccgctgacgattacgaaggcggaactggatgcgctgttcgctgttgcgcatgaggcggtggatgccaccgcaaaggatatggggcttttgtga

SEQ ID NO: 936 - protein, 460 aa, Unknown
  Obtained from environmental sample
  DOMAIN (39)...(390): Aminotransferase class-III
  misc_feature (1)..(460): Xaa is any amino acid
MSEHRRNHNIEELVELDLQHHLHPFTDYKGLRGEGGSRIITHAEGVYLFDGKGNKIIDGMAGLWCVNVGYGRKELAEAAYRQLLELPYYNTFFKTAHPPSIELAAKVSSLLPDNFNSIFFSNSGSEANDTNLRLVHHYWRSVGKPGKVNIISRQNAYHGSTVAGAALGGMSPMHRQGGRLIPTIHHVAQPYWFKDGGDMTPEEFGRYAALQVEEKIKELGPETVGAFIGEPIQGAGGVIIPPDSYWPEINRICKEYDILLICDEVICGFGRTGNWFGLETFGIEPDLITMAKGMSSGYLPISGSAVSDRVAEGIVESGGEFFHGYTYSGHPAACAVALANIEIMQQEKLVDKVRNETGPYLAQKLAELADHPLIGEVRSSGLVGALELVKDKETRTRFKPDGKAGTVCRDHFFKRNAIMRACGDTMVLSPPLTITKAELDALFAVAHEAVDATAKDMGLL

SEQ ID NO: 937 - DNA, 855 bp, Unknown; identical to SEQ ID NO: 3
  Obtained from environmental sample
  misc_feature (1)..(855): n is a, c, g, or t

SEQ ID NO: 938 - protein, 284 aa, Unknown; identical to SEQ ID NO: 4
  Obtained from environmental sample
  DOMAIN (7)...(276): Aminotransferase class IV
  misc_feature (1)..(284): Xaa is any amino acid

SEQ ID NO: 939 - DNA, 855 bp, Unknown
  Obtained from environmental sample
  misc_feature (1)..(855): n is a, c, g, or t
atgtcccgtattgcttatgttaacggtgcttatgttccccacgatgaggctgtggtctcgatcgatgatcgcggctatcagtttgctgatgctgtgtatgaaggtgtgactgtgcgcaaaggccgcatgatagaccttgaaccacacatggacaggctcgcgcgctcgatgcgggagcttgcgatggcagcaccgatggagcgcgcgcccatgcgctttgtgttcagggaggttatccggcgcaaccgtataagcgatggatttctctatatacaaatcagccgcggcgtagcccgacgcgaccatgccttccccaccacacccacggcaccgagccttgttgtaacctgcaaacgcctgagtgttgacggtgtttttgcccgcgcagccaagggtgtgaaggccttttcggaaagtgatatccgctggggtcggtgcgatatcaaatccacgtccctgctcccgaacatcctcgcgaaacaggccgccaaggaaaaaggcggctttgaggccgtgcttgtagaccgggacggttatgtaaccgaaggcagcagcaccaacatgtggatggtacgcaccgacggcacgctggtgacccgctcaacggatgataacattctgcccggcattacccgtgcgacgattaaaaagctggcggaagagttgcagatcaaggtggagacaaaagccttcacgctggaagacgccaaagcaggcgcggagatgttcctctcaagctcgactggctgcgccatgccgattgtggagctggacggccataagattggcgacggaacacccggtcccgtcgccagacgattgattgaagcttaccggacttacatggaggcctaa

SEQ ID NO: 940 - protein, 284 aa, Unknown; identical to SEQ ID NO: 6
  Obtained from environmental sample
  DOMAIN (8)...(279): Aminotransferase class IV
  misc_feature (1)..(284): Xaa is any amino acid

SEQ ID NO: 941 - DNA, 879 bp, Unknown
  Obtained from environmental sample
  misc_feature (1)..(879): n is a, c, g, or t
atggttcgtacggtctatgtaaacggatattatgcgccgtatgagcatgccgtcgtgcatgtcgaggatcggggctatcaattcgcagatgccgcctatgaggtttgcgaagtacgcggcggagcgctgatcgatgagcgcctgcatatggaacggctgcgccggtcgctgggcgagctcagaattgattttcccatgaccatgcgctccctcagcgtgatcctgcacgagacggtgcgccggaaccgggtccgcgacggctccgtctatctccaggtaagccgcggcgtcgccccgcgcgactttgccttcccggacccatccgcgaggccgagcgtggtctgctatgccaaggcgaagccggctgccgcattggagcgccgggcggccaagggcatccgcgtcgtcaccatgccggatatccgctggcgccggccggacatcaaatcggtctcgctgctgcccaatgtgctggcgcggcaggcagcccacgatgtcggagccgacgaagcctggctggtcgacgacaacggctttgtcaccgaaggcgccgcctgcaacgcctggatcctgatcgaggacgatacgctcgtcacccggccggccgaaatggccattttgcgcggcgtcacccgcaccgttctgctgcaggcaattgccgaggcacagctcaaggttgttgagcggccgttcagcgtcgaagaggcaaaaagggccaaggaggccttcataacgtcggcaacgtcgatcataacgccggtgatcgcgataaacggtgtgcccctgggcgacggcaagcccggaccggtagcaatgaagctgcgccggctcttccgggggtcggccgagaaatcaggagccggaacgttgttggaataa

SEQ ID NO: 942 - protein, 292 aa, Unknown; identical to SEQ ID NO: 12
  Obtained from environmental sample
  DOMAIN (8)...(279): Aminotransferase class IV
  misc_feature (1)..(292): Xaa is any amino acid

SEQ ID NO: 943 - DNA, 870 bp, Unknown
  Obtained from environmental sample
  misc_feature (1)..(870): n is a, c, g, or t
atggtttttctgaacgggcagttcgtcgcgttgggggacgccaaggtctccgtgctcgaccgcggcttcatcttcggcgacggcgtctacgaggtcgtgccggtgtactcgcgcgtgccgttccgcctcgacgagcacctcgtgcgactcgagcgcagtctcgccgcggtcgccatccgcaatccgtacagccgcgccgagtggcgcggcttcatcaccgagctggtggcacgccaggacttcgaggaccagggggtctatttccaggttacgcgcggcgtggccaagcgcgaccatgccttcccgaagaacgccgagccgacggttttcatgatggcaagcccgctcgtcaacccgccgcgcgagcaagtggaaaacggcgcgcccgcggtgagcgcgcgcgacaatcgctggctgcgctgcgacatcaagtcgatctcgctcatcggcaacgtgctgctgcgccagctctcggcgcaagtcgacgcggccgagacgatccttttccgcgatggcaagcttaccgaggcctccgcgtcgaacgtgttcattgtgaagttcggcgtcgtcgccgggccgccgaagagctcactcatcctccccggaatcacctacgacgtgatcgtcgagcttgcgcaggctgccggcatcccgctggagctgcgcgaggtaacggaggccgaggtacgcagcgccgacgagctgtgggtgacctcgtcgtccaaggaagtgctcgccatcgtgcacctcgatggcgcgtcgattggcgacgggcggcccggcccggcgttccgccagatgtaccgcctctaccaggatttcaagcagaaggtcatgcgcgcgggccggcgccagtcggtctcggcctaa

SEQ ID NO: 944 - protein, 289 aa, Unknown; identical to SEQ ID NO: 8
  Obtained from environmental sample
  DOMAIN (5)...(272): Aminotransferase class IV
  misc_feature (1)..(289): Xaa is any amino acid

SEQ ID NO: 945 - DNA, 855 bp, Unknown
  Obtained from environmental sample
  misc_feature (1)..(855): n is a, c, g, or t
atgaacgcactaggatattacaacggaaaatggggtcctcttgacgaaatgaccgtgccgatgaacgacaggggctgcttctttggagacggcgtgtacgacgctacctgcgccgctaacggggtgatttttgccctggatgagcacattgacaggtttttcaacagcgcaaaactcctggaaatagaaatcggttttacaaaagaggaactgaaaaaaaccatcaatgaaatgtactccaaagtggataagggggagtaccaggtttattggcaggcgactcgtggaaccggccggcgaagccatgtatttccggcaggtccctcaaatctctggataatgattaagcctaatcacgtcgacgatctttatagaaaaataaagctcattaccacggaagatacccgctttttccactgcaacatcaaaacacttaaccttattcccaatgtcattgcttcccagcgagcgctggaagcgggctgccacgaggcagtttttcaccggggcgaaacagtgaccgaatgcgcccatagcaatgtccacataattaaggacggcaggtttattactcatcaaactgacaacctgatcctccctggcatagcccgcagccatttgttgcaagcctgcgacaggctgaatgttccggttgacgaacgggaatttaccctttcggaattgttcggcgcggatgaggtacttgtgtccagcagcggcacactcggtcttagcgccgatacaatagacggaaaaaatgtgggagggaaagcgccggaactgctaaaaagaattcaggacgaagtgttgaaggaatttatcgaagcgacagctcgtgccgaattctttggataa

SEQ ID NO: 946 - protein, 284 aa, Unknown; identical to SEQ ID NO: 14
  Obtained from environmental sample
  DOMAIN (8)...(270): Aminotransferase class IV
  misc_feature (1)..(284): Xaa is any amino acid

SEQ ID NO: 947 - DNA, 837 bp, Unknown
  Obtained from environmental sample
  misc_feature (1)..(837): n is a, c, g, or t
atgcgcgaaattgtttttttgaatggggaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggatattgaaaatcttcaatcggtttttaactcactcataaccagaaataatcttaatgataaacacgcaggggtatatttgcaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatattaaatcggtttcactgcttcccaatacaatgctgtataacaaagccgtaaatgccggggcgggagagtgcgttttaattcgcaatggaatggttaccgaagctacacattcaagcgttttgtgtgtaaaagacggaattgttattacacgaccactatcaaatctgattcttcccggaattacaagaaaagttgtacaggagatatgctctgtccataatattgcttttgaagagcgcgaattttctgaaactgaattgcttgaaatggatgaaattataattgctggtacggggagcgaaataactccggcaatacaagtaaacgaaacaacgattggaaatggctcaccaggcaaaatcacacggtttattcagcaaaagttttttgagatggtttag

SEQ ID NO: 948 - protein, 278 aa, Unknown; identical to SEQ ID NO: 16
  Obtained from environmental sample
  DOMAIN (8)...(275): Aminotransferase class IV
  misc_feature (1)..(278): Xaa is any amino acid

SEQ ID NO: 949 - DNA, 918 bp, Unknown
  Obtained from environmental sample
  misc_feature (1)..(918): n is a, c, g, or t
atgttggatgaacggatggtgttcattaacggcgactttgtaaagtggcaggacgcaacggtccacatgatgagccacagcttcgcgcgcggctcggccattttcgaagtcatcagcttttacgcgacgggctcgggtccggctgttttccggctggacgatcacatcgcgcgtttggaaaaatcggcaagcttcctgggcatggagcttcccctgagccacgaggcactgtgccgggccgtggcggacaccgtgcgccgcaaccgcctcggtcggggcgtcatcaaggtgatcggctactacccccagttcgcgctcgacattcagccgccgcagaagcgtctggatgttgcggtctttgcgctggagccggcgcaggacctgaaggactttgagttttcctttgaaaagggcaccagtgcaggcatcgcgcgctggcgcaaactcgaccccgagacggtccccatcgaggccaaggccgccgccaactacctgaacgggatgatcgccagccaggatgtccggaaacgagggttcgaggatgccatcctgctggacacccagggattcatcgccgagggcgccaccgaatccgtttttctggtcaaagacggcaagctgctgacgccctgcctggggaccgtgctcgacagcatcacccgccggtccattttgcaggtcgcgcgccatctcgggatcgaaacgatcgaaggccgtctgcggccggcgctgctcttcgaagccgatgaggtctttttcgccaacacccccttcaaggtgatccccgtccgtcgcatcgaggagcgccggatgtcggccactcccggcccgatgcagcgcaggttgtgggatgttttgcagaagatcgccgccggccaagagcctgacttcgccgagtggctctatgccgtggactag

SEQ ID NO: 950 - protein, 305 aa, Unknown; identical to SEQ ID NO: 18
  Obtained from environmental sample
  DOMAIN (10)...(287): Aminotransferase class IV
  misc_feature (1)..(305): Xaa is any amino acid

SEQ ID NO: 951 - DNA, 1206 bp, Pyrolobus fumarius
gtggcgagggtatcgaggaggttccttgaggacagctctagcggcgccaccacaatggcatttgcgcagttggcttccgaggctaaacggaaaccggtgatagacctcaccctaggtcagcccgatgtaacccctccacagactctcgtggagcttctggcgaccgaggctaggggtgtaggagcctcccgctacccgccgccacaaggtctagccgagtatcgcgaggccgtagcatcctacatgcgcgacttttacggtgtcgatgctgagccagagcgtgtcgttgcgcttgcaggtgctaagccgggcatagccgccgccatatactccgtctgtgaccacggcgatgccatgcttgtgctgactccacacttctacgcgtacgtgaacgcggcgcgcatgctaggagtgaagcccgttatggctaggctaaggtgggacggcgggaggcttttcatcgacgaggatgaggtgaagaaggcgtttgaggagcacaagccgtgcctcgttatcgtgaacacaccgcataaccccacgggcctccaccttgatagggagacgctcaagctgataggggatcttgcctcggagcataacacactcgtgctcagcgatgaggtgtactcgtggctcgtgttccgcggtgaacacgtcccgctcctacgcctcctcggcgaagagagagtcatacacctcgagtcgttctcgaagacccttgctatccctggctggcgcgtcggcttcctctacgcgccacgcgaggttgtaaaggcgaccgtcttcttcaattcgaacgtctacactggcatccccaggttcatccagctagccgtagccaagtacatcacagcgtaccgcgaagatatggtcgagtatgtggagagagtgcgtaagctctacgggcggagggcgcgcgtcttcaccgaggccctctcacagctagaggatctcatcgacgtctatgagcccgctgctggcttcttcctattcccgagggtagagcgcctcatagagaagctcggcgtggggagcgcagagaggctcgtagagctgatggccagagaggttggtgtgctggccgtcccgggcaccgtgttcggagaggagtggagaggctacatccgtgttagcctcaccgcgccggagtcaaggcttagggaggcggctgcgaggataggagagctggcaacgcggggggcgtga

SEQ ID NO: 952 - protein, 401 aa, Pyrolobus fumarius; identical to SEQ ID NO: 934
  DOMAIN (31)...(393): Aminotransferase class I and II
  SITE (238)...(251): Aminotransferases class-I pyridoxal-phosphate attachment site. Prosite id = PS00105

SEQ ID NO: 953 - DNA, 1185 bp, Aquifex aeolicus; identical to SEQ ID NO: 927

SEQ ID NO: 954 - protein, 394 aa, Aquifex aeolicus; identical to SEQ ID NO: 928
  DOMAIN (32)...(387): Aminotransferase class I and II
  SITE (34)...(59): Sugar transport proteins signature 2. Prosite id = PS00217
  SITE (232)...(235): N-glycosylation site. Prosite id = PS00001
  SITE (275)...(278): N-glycosylation site. Prosite id = PS00001

SEQ ID NO: 955 - DNA, 879 bp, Unknown
  Obtained from environmental sample
gtggcgtgggtcgatggcgaacttgttccgcttcacgaggcccgcattccgcttctcgatcagggtttcctgcactccgatctgacctatgacgtccccgccgtctgggatggcaggttttttcgccttgatgaccatctcgatcgatttgaggcgagctgcgcgaaactgaagctgaaaagcccgatggatcgcgaaaccatgaaggcaacgcttgtcgagatggtcgccaaaagcggcattcgtgatgcctatgtggaaatgattgtcacgcgtggcctgaaattcgtacgcggcaacaaacccgaggacatcgtaaattcgctttacatgctggtcatgccctatgtgtgggtgatgtcaccggagatacagcgtgttggcggcagtgctgtcatcacccgcacggtgcgccgtgttccgccgggcgccatcaacccaacgatcaagaatctgcaatggggtgatttcgtgcgcggtctgatggaagcgcaggatcgcggcgccatttacccgatccttcccgatggtgacggtaacatcaccgaaggctccggtttcaatgtgttcctggtcaagaatggcgtgctttacacaccggaccgtggcgttctggaaggtgtgacgcgaaaaaccgtgttcgatatcgccgctgccaagggctggaaggttgcccttgaacatgtgccggttgaacttgcctatcatgccgacgaaatatttttctgcacgacggcgggcggcatcatgccggtcacaacattggatggagaacttgttggcggcggacaggttggcccggtcacccgcgcgatctgggacgaatattggaagctgcattacacagcagatttgagttttgcgatcgactatccctga

SEQ ID NO: 956 - protein, 292 aa, Unknown
  Obtained from environmental sample
  DOMAIN (5)...(277): Aminotransferase class IV
  SITE (182)...(185): N-glycosylation site. Prosite id = PS00001
MAWVDGELVPLHEARIPLLDQGFLHSDLTYDVPAVWDGRFFRLDDHLDRFEASCAKLKLKSPMDRETMKATLVEMVAKSGIRDAYVEMIVTRGLKFVRGNKPEDIVNSLYMLVMPYVWVMSPEIQRVGGSAVITRTVRRVPPGAINPTIKNLQWGDFVRGLMEAQDRGAIYPILPDGDGNITEGSGFNVFLVKNGVLYTPDRGVLEGVTRKTVFDIAAAKGWKVALEHVPVELAYHADEIFFCTTAGGIMPVTTLDGELVGGGQVGPVTRAIWDEYWKLHYTADLSFAIDYP

SEQ ID NO: 957 - DNA, 1386 bp, Unknown
  Obtained from environmental sample
atgggcacgcagctctcaaactctcttgtccatgcggacatctcgaccacccttcatccctacaccgacgcccgtgcgcatgaaaagcagggcccgatgatcatcgagcgcggcaagggcatctacatctatgacgacgccggcaaggaatatatcgaaggtctcgccggtctctggtcggtcgccgtcggttttgacgagccgcgccttgtaaaggctgccgccgaccagatggccaagctgccctactatcataccttcagccacaagtcgcacgagccctccatccggctggccgagaagatcgtggaaatgacgcccgagcagctgacgcgcgtcttcttcaccagctcgggatcggaagccaacgacaccatgatcaagatggtgtggttcatgaacaatgcgctgggccgcccgcagaagaagaagttcctcgcccgcacccgcggctatcacggtatcacggtggcatccggcagtctcacgggcctgccgaacaatcatcgcgatttcgacctgccggccatcccggtccgtcacctgagctgcccgcaccactatcgcgtcggcctgcccggagaatccgaggcgcagttcgcgcagcgcctgattgccgaggccgaagccgtgatcctcgaagaaggcccggacacgattgccgccttcatcggcgagccgctgatggctgcaggtggtgtcatgcctccgccggccggttactggcagggcatcgaggcgctgtgccgcaagtatgacatcctgcttgtcgccgacgaagtgatctgcggcttcggtcgtctcggaaccgggttcggctgcgaatactacggcttcacaccggacatcatggtcgtctccaagcagctgacctcgtcctatatgccgcttgcggccgttgtcttcagcgaggcggtctacaacgccatcgccgacaacacggccaagatcggcacgttcggccatggcttcaccgcctccggccatccggttgccaccgccgttggtctggaaaacctcaagatcatcgaagagcgcgatctgatcggcaacgccgcccgcatgggcgccattctccaggcacgtctggcggaactggcggatcacccgctggtgggcgaagtgcgcggcgccggcctcatcgccggtctcgagctggtcgccgacaaggaaacgcgccgccccttcgccacggtcggcaaggcgggtgcccgcgcgttcgcagccggacatgagcatggcctcatcgtgcgcgccatcggcgacgtcgtcgcgctctgcccaccgctcatcatcaatgaggagcaggtgaacgaaacggtgaaccgcctgcgcaaggcgctcgacgacacggccaagtggcgtgctgacgagaacctgaactaa

SEQ ID NO: 958 - protein, 461 aa, Unknown
  Obtained from environmental sample
  DOMAIN (34)...(388): Aminotransferase class-III
  SITE (124)...(127): N-glycosylation site. Prosite id = PS00001
  SITE (444)...(447): N-glycosylation site. Prosite id = PS00001
MGTQLSNSLVHADISTTLHPYTDARAHEKQGPMIIERGKGIYIYDDAGKEYIEGLAGLWSVAVGFDEPRLVKAAADQMAKLPYYHTFSHKSHEPSIRLAEKIVEMTPEQLTRVFFTSSGSEANDTMIKMVWFMNNALGRPQKKKFLARTRGYHGITVASGSLTGLPNNHRDFDLPAIPVRHLSCPHHYRVGLPGESEAQFAQRLIAEAEAVILEEGPDTIAAFIGEPLMAAGGVMPPPAGYWQGIEALCRKYDILLVADEVICGFGRLGTGFGCEYYGFTPDIMVVSKQLTSSYMPLAAVVFSEAVYNAIADNTAKIGTFGHGFTASGHPVATAVGLENLKIIEERDLIGNAARMGAILQARLAELADHPLVGEVRGAGLIAGLELVADKETRRPFATVGKAGARAFAAGHEHGLIVRAIGDVVALCPPLIINEEQVNETVNRLRKALDDTAKWRADENLN

SEQ ID NO: 959 - DNA, 1383 bp, Unknown; identical to SEQ ID NO: 935
  Obtained from environmental sample

SEQ ID NO: 960 - protein, 460 aa, Unknown; identical to SEQ ID NO: 936
  Obtained from environmental sample
  DOMAIN (39)...(390): Aminotransferase class-III
  SITE (129)...(132): N-glycosylation site. Prosite id = PS00001
  SITE (160)...(170): Serine proteases, subtilase family, histidine active site. Prosite id = PS00137
  SITE (360)...(363): N-glycosylation site. Prosite id = PS00001

SEQ ID NO: 961 - DNA, 1260 bp, Unknown
  Obtained from an evironmental sample
atgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctag

SEQ ID NO: 962 - protein, 419 aa, Unknown; identical to SEQ ID NO: 254
  Obtained from an environmental sample

SEQ ID NO: 963 - DNA, 1260 bp, Unknown; identical to SEQ ID NO: 961
  Obtained from an environmental sample

SEQ ID NO: 964 - protein, 419 aa, Unknown; identical to SEQ ID NO: 254
  Obtained from an environmental sample

SEQ ID NO: 965 - DNA, 2267 bp, Unknown
  Obtained from an environmental sample
atgggaactgtttcgaacgtggtgggacaactggccgggagcgaaggcgtgagcggcaccacaggcatccgcgtgatcgactcgcacaccgagggtgagccgacgcgcgtcgtcatcgacggcggcccggatcttggagagggaactctctcggaaaggcgggagcggttccgccggtcgtttgacgacttccgccgtgcggtgatcctcgagccgcgcggctcggatgtgctggtcggggcgctgctgtgcgaaccggtcgatccctcgtgtgcagcgggggtgatcttcttcaacaacaccggctacctggggatgtgcggtcacggcgcgatgggggtggcagcgactttggcgcatctcggccggatcaacttcggcaggcatcgtctggagacgcctgtcggcgtcgtcgaggttgagttgcacgatccgcatcgcgtgagcgttgagaacgtgccgagctatcgctggcggagcggcgtctgcttcgaggtcgagtcgctggggaccgtcaccggcgatgtcgcgtggggcggcaactggttcttcctggtggagggttcgccgctgccgctccttccggagaacgcccgctcgctgacggacgccgctcagcagatcaggcaggcattgatcgcaaacgggatcgccggtgaggatggtgccgagatcgaccacatcgagctgttcgggccggcaggcgcccccgatgctcacggccgcaacttcgtgctctgtcccggcggtgcgtgggatcgctctccctgcgggaccgggacgagcgcgaagctggcctgcctggccgccgacggaaaactcgcacccgggcaggtgtgggtgcaggagagcctgatcggcagccggttctgggcgtcgtatcgtgaggcgtcggacgggaagatcatcccccgcatcaccggccgggcgtatgtgtgcggcgaggcgaccctgtttcgacatcccgatgacccgttccgtgacggaatctccatcgagggggcttcatgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctag

SEQ ID NO: 966 - protein, 738 aa, Unknown
  Obtained from an environmental sample
MGTVSNVVGQLAGSEGVSGTTGIRVIDSHTEGEPTRVVIDGGPDLGEGTLSERRERFRRSFDDFRRAVILEPRGSDVLVGALLCEPVDPSCAAGVIFFNNTGYLGMCGHGAMGVAATLAHLGRINFGRHRLETPVGVVEVELHDPHRVSVENVPSYRWRSGVCFEVESLGTVTGDVAWGGNWFFLVEGSPLPLLPENARSLTDAAQQIRQALIANGIAGEDGAEIDHIELFGPAGAPDAHGRNFVLCPGGAWDRSPCGTGTSAKLACLAADGKLAPGQVWVQESLIGSRFWASYREASDGKIIPRITGRAYVCGEATLFRHPDDPFRDGISIEGASRAEPRTGRSSSVRGSSGSPVRTTCARRDSRRSTGGRSQARARMPTAVSVPATCCRRIRALFVPRSRCSRRTLRFGSSHGVRRCGRGCGTSPAGAITVRCPPRGISRRSSNRLWLSIGDWFPRSPSSANGRRVDCTCSPTVACTRSPRRTGSASTSACPHGGSRGANCRRSTRPSSRAWRGRSTTRGTLRSAPTATQAGPRGCGSGEGSSSSARCSGSSLREDGLRRCRRCRERWPRSSSSSRRVPGAAGWRATSAAGFRCSPAKGTRRWPGPSPVRGFRCCSPSTASPSRHSNRGIASVRWSSPASIRRFDRSGSSSYEHRQSPTWWHLTPKSSTNDGTAGGRRATACRSSAGCPLWRTRTWRPATTCWVSVSPLRPADSSPRSSPACRRMSTRHPTVQTGS

SEQ ID NO: 967 - DNA, 2267 bp, Unknown; identical to SEQ ID NO: 965
  Obtained from an environmental sample

SEQ ID NO: 968 - protein, 738 aa, Unknown; identical to SEQ ID NO: 966
  Obtained from an environmental sample

SEQ ID NO: 969 - DNA, 852 bp, Unknown
  Obtained from an environmental sample
atggcaaagattttatggaatgatcaaatcgtagaagaaaaagaagtgaaaattggttttgaagaccgtgggtatcaatttggtgatggagtatatgaagtagtcaaaatttataatggtgatttgtttacggcaaaggaacatatagatcgcctgtatgcaagtgctgacaaaattcaaatagtcataccctttacaaaagataagctacatcaattaatgcacgaattaattgaaacgaacgaggttaagaacggtcagatttatttacagatcacacgaggggacagtccacgagttcataacttccctaatccagcagtgaactctgtactaaccgcttatactaaagaaacaaaacgtccactggcacagcaggaaagtggtatcaaagcttgttttgtagaggatattcgatggttaagatgtgatataaaatcactaaacctacttggtaacgtgcttgcaaaacaagaagcagttactaaaggttgctttgaagccattttacatcgtggggaaactattacagaaggttcttcctctaatatgtacggcattaaagatggtgttttgtatacacatccgattagtaacctaattttaaatggtattactagaaaagtgctgttagattgctgtgaggaaataggacttaaggtagttgaagaggcgtttacgaaagaagaggcgctaaacatggacgaatttatcatgtcatcaactagcgctgaggtaatgccggttatatccatcgatgggaatgttattggggacggaaaacctggagagtttacaagaaagcttcagaaagcctttgaacaaaaaattccatccactttaaatgtatag

SEQ ID NO: 970 - protein, 283 aa, Unknown; identical to SEQ ID NO: 34
  Obtained from an environmental sample

SEQ ID NO: 971 - DNA, 1077 bp, Unknown
  Obtained from an environmental sample
atgccgaagcatcgcaaggctcgcttgcgtcgccaagggctggcggctaagcacggcccgacttttcgcacttcggagcctgccttgaccggtcaagtgaataccaagccccgcggccgccagttcttcaacaatccgggtccgaccaacattcccgaccgcatcctgcgggcgatggaccggccggtgatggacttcctcgcccccgaattcctcgagatgcaccgcgcctgctacgccggcatgaagcgcatcttcaagaccgaccaggaaatctacttccatgcctcgaccggccacggcgcctgggaagcggcggtcgccaacctgttctcgcccggcgacctcgtgctggtgatcgagaccggctacttctcgctgggcttcaaggagctcgccgagacgctcggcctgaaggtcgaggtggtcggcgccgactggcgcaagggcctcgagttcgcgaagctcaccgagcgcctcgccgccgacaagggccacgagatcaaggccgtgctcgccgtgcacaacgagaccgcgaccggcatggtgctgccgctcgccgaggtccgccgcgcgatggaccagaccaagcatccggcgctgctgctcagcgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaaggccaagctgcccaagtactacttcaactgggagctgatggagcagcgcaagccgcagcgcttcatcgggaccgtgccggtccatttcttcttcggcctgaccgagtcgatcaagatgatcgaggaggagacgctggaaggcgtgttctcccgccacgcccggctcggcgaggcgacccgcgccgcggtgcgcgcctggggcaaggacggcaagggcccgtcgctgttcggccagaccgaggaccgtctctccaactcggtcaccacggtgatgatgcccgagggccacacctccgacgccctcgtgccgaattag

SEQ ID NO: 972 - protein, 358 aa, Unknown
  Obtained from an environmental sample
MPKHRKARLRRQGLAAKHGPTFRTSEPALTGQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETLGLKVEVVGADWRKGLEFAKLTERLAADKGHEIKAVLAVHNETATGMVLPLAEVRRAMDQTKHPALLLSDTISSLGSMEYKMDAWGIDVTIAGSQKGLMLPTGMAITGVSKKALEASRKAKLPKYYFNWELMEQRKPQRFIGTVPVHFFFGLTESIKMIEEETLEGVFSRHARLGEATRAAVRAWGKDGKGPSLFGQTEDRLSNSVTTVMMPEGHTSDALVPN

SEQ ID NO: 973 - DNA, 861 bp, Unknown
  Obtained from an environmental sample
atggacgcactgggatattacaacggaaattgggggcctctggacgagatgactgtgccgatgaacgacaggggctgctactttggagacggcgtatacgacgctacctgcgccgttaacggagttatttttgccctggatgagcacattgacaggtttttcaacagcgcaaagctcctggaaataaatattagcttaacaaaagaggaattgaaaaaaactttaaatgaaatgtactccaaagtggataaaggagagtacctggtttattggcaggtgactcgcggaacaggccggcgaagccatgtatttccggcaggcccttcaaatctctggattataattaagcccaatcacatcgacaatctttatagaaaaatcaagctcattaccatggatgatacccgcttcctacactgcaacatcaagacccttaaccttatacccaatgtcattgcttcccagcgggcgctggaagcgggttgccacgaggcggtatttcaccggggcgaaacggtaaccgagtgcgctcacagcaatgtccatatcattaaaaacggcaggtttattacccatccggcggacaacctgatcctccggggtacagcccgcagtcatttattgcaggcctgtgtcaggcttaacattccggtagacgaacgggaattttccctttcggaattattcgacgcggacgaggtgcttgtgtccagcagcggcacactcggccttagcgccgaagaaatcgacggaaaaaaagcgggagggaaagcgcctgaactgctaaaaaaaatccaggatgaagtgctgagggaatttatcgaagcgacaggctacacgcctgagtggagcagggtataa

SEQ ID NO: 974 - protein, 286 aa, Unknown; identical to SEQ ID NO: 220
  Obtained from an environmental sample

SEQ ID NO: 975 - DNA, 879 bp, Unknown
  Obtained from an environmental sample
atggcgtgggtcgatggcgaactcgttccgcttcacgaggcccgcattccgcttcttgatcagggtttcctgcattccgatctgacctatgacgtacccgccgtttgggatggcaggtttttccgccttgatgatcacctcgatcgatttgaggtgagctgcgcgaaactgaagctgaaaagcccgatggatcgcgaaaccatgaaggcaacacttgtcgagatggtggcgaaaagcggcatccgtgatgcctatgtggaaatgatcgtcacacgaggtctgaaattcgtgcgcggcaacaaacccgaagacatcgtgaattcgctttacatgctggtcatgccctatgtgtgggtgatgtcaccggaaatacagcgtgttggcggcagtgcggtgatcacccgcacggtgcgtcgtgttcccccgggcgccatcgacccgacgatcaagaacctgcaatggggtgatttcgtgcgcggtctgatggaagcgcaggatcgcggtgccatttacccgatccttcccgatggtgacggcaacatcaccgaaggctccggcttcaatgtgttcctggtcaagaatggcgtgctttacacaccggaccgtggcgttctggaaggtgtgacacgaaagaccgtgttcgatatcgccgccgtcaagggctggaaggttgcccttgaacatgtgccggttgaacttgcctatcatgccgacgaaatctttttctgcacgacggcaggcggcatcatgccggtcacgacgctggatggagaacttgttggcggcggacaggttggcccggtcactcgcgctatttgggacgaatactggaagctgcattacacagaagatttgagttttgcggtggattatccctaa

SEQ ID NO: 976 - protein, 292 aa, Unknown; identical to SEQ ID NO: 2
  Obtained from an environmental sample

SEQ ID NO: 977 - DNA, 45 bp, Artificial Sequence
  Oligonucleotide
ccatgggaggatccagatctcatcaccatcaccatcactaagctt

SEQ ID NO: 978 - DNA, 42 bp, Artificial Sequence
  Oligonucleotide
ccgccccatatgaacgcactaggatattacaacggaaaatgg

SEQ ID NO: 979 - DNA, 37 bp, Artificial Sequence
  Oligonucleotide
ggcggatccttatccaaagaattcggcacgagctgtc

SEQ ID NO: 980 - DNA, 36 bp, Artificial Sequence
  Oligonucleotide
ccgccccatatgcgcgaaattgtttttttgaatggg

SEQ ID NO: 981 - DNA, 45 bp, Artificial Sequence
  Oligonucleotide
cggatccctaaaccatctcaaaaaacttttgctgaataaaccgtg

SEQ ID NO: 982 - DNA, 39 bp, Artificial Sequence
  Oligonucleotide
ccgccccatatgttggatgaacggatggtgttcattaac

SEQ ID NO: 983 - DNA, 35 bp, Artificial Sequence
  Oligonucleotide
ggcggatccctagtccacggcatagagccactcgg

SEQ ID NO: 984 - DNA, 40 bp, Artificial Sequence
  Oligonucleotide
ggccgcatatggacgcactgggatattacaacggaaaatg

SEQ ID NO: 985 - DNA, 41 bp, Artificial Sequence
  Oligonucleotide
ggccgcggccgcctatgcctttctccactcaggcgtgtagc

SEQ ID NO: 986 - DNA, 40 bp, Artificial Sequence; identical to SEQ ID NO: 984
  Oligonucleotide

SEQ ID NO: 987 - DNA, 42 bp, Artificial Sequence
  Oligonucleotide
ggccgcggccgcctatactgtgctccactcaggcgtgtagcc

SEQ ID NO: 988 - DNA, 37 bp, Artificial Sequence
  Oligonucleotide
catatgtattcattatggaatgatcaaatagtgaagg

SEQ ID NO: 989 - DNA, 40 bp, Artificial Sequence
  Oligonucleotide
gcggccgcctatttattcgtaaaaggtgttggaattttcg

SEQ ID NO: 990 - DNA, 25 bp, Artificial Sequence
  Oligonucleotide
catatgagcaccccgccgaccaatc

SEQ ID NO: 991 - DNA, 32 bp, Artificial Sequence
  Oligonucleotide
gcggccgcctaggccgccttcacttcacgctc

SEQ ID NO: 992 - DNA, 26 bp, Artificial Sequence
  Oligonucleotide
catatgagcaccccgccaaccaattc

SEQ ID NO: 993 - DNA, 30 bp, Artificial Sequence
  Oligonucleotide
gcggccgcctacgcggccttcacttcgcgc

SEQ ID NO: 994 - DNA, 34 bp, Artificial Sequence
  Oligonucleotide
tccaggcatatgagcacagtatatttaaatggcc

SEQ ID NO: 995 - DNA, 39 bp, Artificial Sequence
  Oligonucleotide
ccagtagcggccgcctaacactcaacactatacttatgc

SEQ ID NO: 996 - DNA, 29 bp, Artificial Sequence
  Oligonucleotide
tctaggcatatggtttatctgaacgggcg

SEQ ID NO: 997 - DNA, 34 bp, Artificial Sequence
  Oligonucleotide
actgtagcggcggcctatccgagggacgcgttgg

SEQ ID NO: 998 - DNA, 36 bp, Artificial Sequence
  Oligonucleotide
catatgaaagagctgggctattacaacggaaaaatc

SEQ ID NO: 999 - DNA, 39 bp, Artificial Sequence
  Oligonucleotide
gcggccgcctatgacctccacccctgatttccaaaatac

SEQ ID NO: 1000 - DNA, 33 bp, Artificial Sequence
  Oligonucleotide
ctaggattccatatgaagaattcgccgatcatc

SEQ ID NO: 1001 - DNA, 27 bp, Artificial Sequence
  Oligonucleotide
cgaagcttcaacagcggccgcttaaag

SEQ ID NO: 1002 - DNA, 45 bp, Artificial Sequence
  Oligonucleotide
aattatttgtttcatcaacaaattctgaaattacgccggttattg

SEQ ID NO: 1003 - DNA, 32 bp, Artificial Sequence
  Oligonucleotide
cttgtgtccagcagcaacacactcggccttag

SEQ ID NO: 1004 - DNA, 31 bp, Artificial Sequence
  Oligonucleotide
gtccagcagcggcaacctcggccttagcgcc

SEQ ID NO: 1005 - DNA, 37 bp, Artificial Sequence; identical to SEQ ID NO: 988
  Oligonucleotide

SEQ ID NO: 1006 - DNA, 39 bp, Artificial Sequence
  Oligonucleotide
ctcgagtttattcgtaaaaggtgttggaattttcgtttc

SEQ ID NO: 1007 - DNA, 40 bp, Artificial Sequence
  Oligonucleotide
catatgagttatagcttatggaatgaccaaattgtgaatg

SEQ ID NO: 1008 - DNA, 36 bp, Artificial Sequence
  Oligonucleotide
ctcgagtgcgcgaataccttttgggattttcgtatc

SEQ ID NO: 1009 - DNA, 33 bp, Artificial Sequence
  Oligonucleotide
ctaggatctcatatggacgcactgggatattac

SEQ ID NO: 1010 - DNA, 26 bp, Artificial Sequence
  Oligonucleotide
gcctcgagtaccctgctccactcagg

SEQ ID NO: 1011 - DNA, 33 bp, Artificial Sequence
  Oligonucleotide
ctaggattccatatggacgcgcttggctattac

SEQ ID NO: 1012 - DNA, 25 bp, Artificial Sequence
  Oligonucleotide
gcctcgagtaccctgctccacgcag

SEQ ID NO: 1013 - DNA, 27 bp, Artificial Sequence
  Oligonucleotide
ggttcatatggagaatttaggttatta

SEQ ID NO: 1014 - DNA, 32 bp, Artificial Sequence
  Oligonucleotide
ggaagcggccgcatattctacctcctattctg

SEQ ID NO: 1015 - DNA, 40 bp, Artificial Sequence
  Oligonucleotide
ggttcatatgaaagatttaggatattacaatggagaatac

SEQ ID NO: 1016 - DNA, 42 bp, Artificial Sequence
  Oligonucleotide
ggaagcggccgcttaatttgtttcttccaaaaattcattaag

SEQ ID NO: 1017 - DNA, 40 bp, Artificial Sequence
  Oligonucleotide
atgaagcaagttggatactacaatggtactatcgctgatt

SEQ ID NO: 1018 - DNA, 39 bp, Artificial Sequence
  Oligonucleotide
taaatgaacttaaggtgcctgctactgatcgtgcacttt

SEQ ID NO: 1019 - DNA, 40 bp, Artificial Sequence
  Oligonucleotide
ttttggtgatggttgctacgatgcaactacatttaagaac

SEQ ID NO: 1020 - DNA, 40 bp, Artificial Sequence
  Oligonucleotide
aatgttgcatttgccttagaagatcatcttgatcgttttt

SEQ ID NO: 1021 - DNA, 40 bp, Artificial Sequence
  Oligonucleotide
ataatagttgtcgcctactagagatcgatttccctttaaa

SEQ ID NO: 1022 - DNA, 40 bp, Artificial Sequence
  Oligonucleotide
tcgcgatgaacttaaagaaaagctttacgctgttattgat

SEQ ID NO: 1023 - DNA, 40 bp, Artificial Sequence
  Oligonucleotide
gctaacgaagttgatactggtatcctttattggcaaactt

SEQ ID NO: 1024 - DNA, 40 bp, Artificial Sequence
  Oligonucleotide
cacgtggttctggtttacgtaaccatattttcccagaaga

SEQ ID NO: 1025 - DNA, 40 bp, Artificial Sequence
  Oligonucleotide
tagccaacctaatttattaatttttactgctccttatggt

SEQ ID NO: 1026 - DNA, 40 bp, Artificial Sequence
  Oligonucleotide
ttagttccatttgatactgaatataaacttatatctcgcg

SEQ ID NO: 1027 - DNA, 40 bp, Artificial Sequence
  Oligonucleotide
aagacactcgcttcttacattgcaatattaaaactttgaa

SEQ ID NO: 1028 - DNA, 40 bp, Artificial Sequence
  Oligonucleotide
tttacttccaaacgttattgcaagtcaaaaggctaatgaa

SEQ ID NO: 1029 - DNA, 40 bp, Artificial Sequence
  Oligonucleotide
agtcattgccaagaagtggtcttccatcgcggtgacagag

SEQ ID NO: 1030 - DNA, 40 bp, Artificial Sequence
  Oligonucleotide
ttacagaatgtgcacactctaacatcttaattctaaaaga

SEQ ID NO: 1031 - DNA, 40 bp, Artificial Sequence
  Oligonucleotide
tggcgttctttgctccccacctagagataatttaatcttg

SEQ ID NO: 1032 - DNA, 40 bp, Artificial Sequence
  Oligonucleotide
ccaggaattactttgaaacatctcttgcaattagcaaaag

SEQ ID NO: 1033 - DNA, 40 bp, Artificial Sequence
  Oligonucleotide
aaaataatattcctacttccgaagcaccattcactatgga

SEQ ID NO: 1034 - DNA, 40 bp, Artificial Sequence
  Oligonucleotide
tgatcttagaaatgctgatgaagttattgttagttcttca

SEQ ID NO: 1035 - DNA, 40 bp, Artificial Sequence
  Oligonucleotide
gcttgtctaggtattcgcgcagtcgagcttgatggtcagc

SEQ ID NO: 1036 - DNA, 40 bp, Artificial Sequence
  Oligonucleotide
ctgttggtggaaaagatggaaagactttaaagatcttgca

SEQ ID NO: 1037 - DNA, 46 bp, Artificial Sequence
  Oligonucleotide
agatgcttatgctaagaaatataatgctgaaactgtaagtcgttaa

SEQ ID NO: 1038 - DNA, 20 bp, Artificial Sequence
  Oligonucleotide
tagtatccaacttgcttcat

SEQ ID NO: 1039 - DNA, 40 bp, Artificial Sequence
  Oligonucleotide
aggcaccttaagttcatttaaatcagcgatagtaccattg

SEQ ID NO: 1040 - DNA, 40 bp, Artificial Sequence
  Oligonucleotide
cgtagcaaccatcaccaaaataaagtgcacgatcagtagc

SEQ ID NO: 1041 - DNA, 40 bp, Artificial Sequence
  Oligonucleotide
tctaaggcaaatgcaacattgttcttaaatgtagttgcat

SEQ ID NO: 1042 - DNA, 40 bp, Artificial Sequence
  Oligonucleotide
tagtaggcgacaactattataaaaacgatcaagatgatct

SEQ ID NO: 1043 - DNA, 40 bp, Artificial Sequence
  Oligonucleotide
tttctttaagttcatcgcgatttaaagggaaatcgatctc

SEQ ID NO: 1044 - DNA, 40 bp, Artificial Sequence
  Oligonucleotide
ccagtatcaacttcgttagcatcaataacagcgtaaagct

SEQ ID NO: 1045 - DNA, 40 bp, Artificial Sequence
  Oligonucleotide
acgtaaaccagaaccacgtgaagtttgccaataaaggata

SEQ ID NO: 1046 - DNA, 40 bp, Artificial Sequence
  Oligonucleotide
ttaataaattaggttggctatcttctgggaaaatatggtt

SEQ ID NO: 1047 - DNA, 40 bp, Artificial Sequence
  Oligonucleotide
tcagtatcaaatggaactaaaccataaggagcagtaaaaa

SEQ ID NO: 1048 - DNA, 40 bp, Artificial Sequence
  Oligonucleotide
atgtaagaagcgagtgtcttcgcgagatataagtttatat

SEQ ID NO: 1049 - DNA, 40 bp, Artificial Sequence
  Oligonucleotide
caataacgtttggaagtaaattcaaagttttaatattgca

SEQ ID NO: 1050 - DNA, 40 bp, Artificial Sequence
  Oligonucleotide
accacttcttggcaatgactttcattagccttttgacttg

SEQ ID NO: 1051 - DNA, 40 bp, Artificial Sequence
  Oligonucleotide
agagtgtgcacattctgtaactctgtcaccgcgatggaag

SEQ ID NO: 1052 - DNA, 40 bp, Artificial Sequence
  Oligonucleotide
gtggggagcaaagaacgccatcttttagaattaagatgtt

SEQ ID NO: 1053 - DNA, 40 bp, Artificial Sequence
  Oligonucleotide
tgtttcaaagtaattcctggcaagattaaattatctctag

SEQ ID NO: 1054 - DNA, 40 bp, Artificial Sequence
  Oligonucleotide
ggaagtaggaatattattttcttttgctaattgcaagaga

SEQ ID NO: 1055 - DNA, 40 bp, Artificial Sequence
  Oligonucleotide
catcagcatttctaagatcatccatagtgaatggtgcttc

SEQ ID NO: 1056 - DNA, 40 bp, Artificial Sequence
  Oligonucleotide
gcgcgaatacctagacaagctgaagaactaacaataactt

SEQ ID NO: 1057 - DNA, 40 bp, Artificial Sequence
  Oligonucleotide
tccatcttttccaccaacaggctgaccatcaagctcgact

SEQ ID NO: 1058 - DNA, 40 bp, Artificial Sequence
  Oligonucleotide
atttcttagcataagcatcttgcaagatctttaaagtctt

SEQ ID NO: 1059 - DNA, 26 bp, Artificial Sequence
  Oligonucleotide
ttaacgacttacagtttcagcattat

SEQ ID NO: 1060 - DNA, 33 bp, Artificial Sequence
  Oligonucleotide
ttggccaagcggccgcttaacgacttacagttt

SEQ ID NO: 1061 - DNA, 33 bp, Artificial Sequence
  Oligonucleotide
ggttccaaggcatatgaagcaagttggatacta

SEQ ID NO: 1062 - DNA, 35 bp, Artificial Sequence
  Oligonucleotide
gtgattgtttcatcaacgaattcagaagtaacgcc

SEQ ID NO: 1063 - DNA, 843 bp, Clostridium acetobutylicum
atgaaagatttaggatattacaatggagaatacgacttaattgaaaatatgaaaataccaatgaatgatcgtgtatgctattttggtgatggtgtttatgatgctacttatagtagaaaccataatatatttgcactagatgagcatattgaccgattttataatagtgccgagcttttaagaattaaaattccatatacaaagaaggaaatgaaagagcttttaaaggatatggttaaaaaggttgatagcggagaacaatttgtatattggcaggttactagaggtactggcatgcgtaatcatgcttttttgagtgaggatgttaaggctaatatttggattgttttaaagccactaaaggtaaaagatatgtcaaaaaaattaaaactaataacattagaggatactagatttttacattgtaacataaaaaccttaaatttgcttcctagtgtaattgcagcacaaaaaactgaagaagcaggctgccaggaagcagtatttcatagaggagatagagttactgaatgtgctcatagtaatgtttcaattataaaggatgagattttaaaaactgcgccaacagataatcttattttgccgggaatagcaagggcgcatcttataaaaatgtgcaaaaaatttgagatacctgtagatgaaactccatttacattaaaggagttaattaatgcggatgaagttatagttacaagttcagggcaattttgtatgactgcttgtgagatagatggaagacctgtaggcggaaaagcgccagatattattaaaaagcttcagactgccttacttaatgaatttttggaagaaacaaattaa

SEQ ID NO: 1064 - protein, 280 aa, Clostridium acetobutylicum
MKDLGYYNGEYDLIENMKIPMNDRVCYFGDGVYDATYSRNHNIFALDEHIDRFYNSAELLRIKIPYTKKEMKELLKDMVKKVDSGEQFVYWQVTRGTGMRNHAFLSEDVKANIWIVLKPLKVKDMSKKLKLITLEDTRFLHCNIKTLNLLPSVIAAQKTEEAGCQEAVFHRGDRVTECAHSNVSIIKDEILKTAPTDNLILPGIARAHLIKMCKKFEIPVDETPFTLKELINADEVIVTSSGQFCMTACEIDGRPVGGKAPDIIKKLQTALLNEFLEETN

SEQ ID NO: 1065 - DNA, 849 bp, Clostridium beijerinckii
atggagaatttaggttattataatggaaagtttggattattagaggaaatgacagtaccaatgcttgatcgtgtttgctattttggagatggagtttatgatgctacttatagcagaaatcacaagatttttgcattggaggagcatattgaaagattttacaacagcgctggtttattaggaattaaaattccttattcaaaggagcaagtaaaagaaatccttaaggagatggtattaaaggttgattcaggagaacaatttgtatattggcaaattactagaggaactggaatgagaaatcatgcttttcctggagatgaggtccctgcaaatctatggattatgttaaagcctttaaatattaaggatatgtcacaaaaattaaagttaatcactttagaagacactagatttttacactgtaatatcaaaaccttaaatttattaccaagtgtaattgcatctcaaaaaactgaagaggcaggatgtcaggaagctgtatttcatagaggggatagagtaactgaatgtgcacatagcaatgtatcaattattaaggatggtatattaaaaactgctccaacagacaatttaattttaccaggtatagcaagagctcaccttattaaaatgtgtaaatcctttaatattcctgtagatgaaacagcatttaccttgaaggaattaatggaggcagatgaagttatagttactagttcaggtcaattttgtatggcaaccagtgaaatagatggaatacctgtagggggaaaagcaccagagcttgtaaagaaattacaagatgcattgttaaatgagttcttagaagaaacaaaaacagaatag

SEQ ID NO: 1066 - protein, 282 aa, Clostridium beijerinckii
MENLGYYNGKFGLLEEMTVPMLDRVCYFGDGVYDATYSRNHKIFALEEHIERFYNSAGLLGIKIPYSKEQVKEILKEMVLKVDSGEQFVYWQITRGTGMRNHAFPGDEVPANLWIMLKPLNIKDMSQKLKLITLEDTRFLHCNIKTLNLLPSVIASQKTEEAGCQEAVFHRGDRVTECAHSNVSIIKDGILKTAPTDNLILPGIARAHLIKMCKSFNIPVDETAFTLKELMEADEVIVTSSGQFCMATSEIDGIPVGGKAPELVKKLQDALLNEFLEETKTE

SEQ ID NO: 1067 - DNA, 846 bp, Lactobacillus salivarius
atgaagcaagttggatactacaatggtactatcgctgatttaaatgaacttaaggtgcctgctactgatcgtgcactttattttggtgatggttgctacgatgcaactacatttaagaacaatgttgcatttgccttagaagatcatcttgatcgtttttataatagttgtcgcctactagagatcgatttccctttaaatcgcgatgaacttaaagaaaagctttacgctgttattgatgctaacgaagttgatactggtatcctttattggcaaacttcacgtggttctggtttacgtaaccatattttcccagaagatagccaacctaatttattaatttttactgctccttatggtttagttccatttgatactgaatataaacttatatctcgcgaagacactcgcttcttacattgcaatattaaaactttgaatttacttccaaacgttattgcaagtcaaaaggctaatgaaagtcattgccaagaagtggtcttccatcgcggtgacagagttacagaatgtgcacactctaacatcttaattctaaaagatggcgttctttgctccccacctagagataatttaatcttgccaggaattactttgaaacatctcttgcaattagcaaaagaaaataatattcctacttccgaagcaccattcactatggatgatcttagaaatgctgatgaagttattgttagttcttcagcttgtctaggtattcgcgcagtcgagcttgatggtcagcctgttggtggaaaagatggaaagactttaaagatcttgcaagatgcttatgctaagaaatataatgctgaaactgtaagtcgttaa

SEQ ID NO: 1068 - protein, 281 aa, Lactobacillus salivarius
MKQVGYYNGTIADLNELKVPATDRALYFGDGCYDATTFKNNVAFALEDHLDRFYNSCRLLEIDFPLNRDELKEKLYAVIDANEVDTGILYWQTSRGSGLRNHIFPEDSQPNLLIFTAPYGLVPFDTEYKLISREDTRFLHCNIKTLNLLPNVIASQKANESHCQEVVFHRGDRVTECAHSNILILKDGVLCSPPRDNLILPGITLKHLLQLAKENNIPTSEAPFTMDDLRNADEVIVSSSACLGIRAVELDGQPVGGKDGKTLKILQDAYAKKYNAETVSR

SEQ ID NO: 1069 - protein, 60183 aa, Artificial Sequence
  Description of Artificial Sequence: Synthetic consensus sequence
  MOD_RES (2)..(1001): This region may encompass 0-1,000 residues chosen from any of the twenty naturally occurring  amino acids; see specification for preferred embodiments
  MOD_RES (1006)..(2005): This region may encompass 0-1,000 residues chosen from any of the twenty naturally occurring amino acids; see specification for preferred embodiments
  MOD_RES (2008)..(3007): This region may encompass 0-1,000 residues chosen from any of the twenty naturally occurring amino acids; see specification for preferred embodiments
  MOD_RES (3018)..(4017): This region may encompass 0-1,000 residues chosen from any of the twenty naturally occurring amino acids; see specification for preferred embodiments
  MOD_RES (4021)..(5020): This region may encompass 0-1,000 residues chosen from any of the twenty naturally occurring amino acids; see specification for preferred embodiments
  MOD_RES (5024)..(6023): This region may encompass 0-1,000 residues chosen from any of the twenty naturally occurring amino acids; see specification for preferred embodiments
  MOD_RES (6025)..(7024): This region may encompass 0-1,000 residues chosen from any of the twenty naturally occurring amino acids; see specification for preferred embodiments
  MOD_RES (7027)..(8026): This region may encompass 0-1,000 residues chosen from any of the twenty naturally occurring amino acids; see specification for preferred embodiments
  MOD_RES (8029)..(9028): This region may encompass 0-1,000 residues chosen from any of the twenty naturally occurring amino acids; see specification for preferred embodiments
  MOD_RES (9031)..(10030): This region may encompass 0-1,000 residues chosen from any of the twenty naturally occurring amino acids; see specification for preferred embodiments
  MOD_RES (10038)..(11037): This region may encompass 0-1,000 residues chosen from any of the twenty naturally occurring amino acids; see specification for preferred embodiments
  MOD_RES (11042)..(12041): This region may encompass 0-1,000 residues chosen from any of the twenty naturally occurring amino acids; see specification for preferred embodiments
  MOD_RES (12043)..(13042): This region may encompass 0-1,000 residues chosen from any of the twenty naturally occurring amino acids; see specification for preferred embodiments
  MOD_RES (13046)..(14045): This region may encompass 0-1,000 residues chosen from any of the twenty naturally occurring amino acids; see specification for preferred embodiments
  MOD_RES (14047)..(15046): This region may encompass 0-1,000 residues chosen from any of the twenty naturally occurring amino acids; see specification for preferred embodiments
  MOD_RES (15048)..(16047): This region may encompass 0-1,000 residues chosen from any of the twenty naturally occurring amino acids; see specification for preferred embodiments
  MOD_RES (16049)..(17048): This region may encompass 0-1,000 residues chosen from any of the twenty naturally occurring amino acids; see specification for preferred embodiments
  MOD_RES (17051)..(18050): This region may encompass 0-1,000 residues chosen from any of the twenty naturally occurring amino acids; see specification for preferred embodiments
  MOD_RES (18054)..(19053): This region may encompass 0-1,000 residues chosen from any of the twenty naturally occurring amino acids; see specification for preferred embodiments
  MOD_RES (19059)..(20058): This region may encompass 0-1,000 residues chosen from any of the twenty naturally occurring amino acids; see specification for preferred embodiments
  MOD_RES (20068)..(21067): This region may encompass 0-1,000 residues chosen from any of the twenty naturally occurring amino acids; see specification for preferred embodiments
  MOD_RES (21069)..(22068): This region may encompass 0-1,000 residues chosen from any of the twenty naturally occurring amino acids; see specification for preferred embodiments
  MOD_RES (22070)..(23069): This region may encompass 0-1,000 residues chosen from any of the twenty naturally occurring amino acids; see specification for preferred embodiments
  MOD_RES (23073)..(24072): This region may encompass 0-1,000 residues chosen from any of the twenty naturally occurring amino acids; see specification for preferred embodiments
  MOD_RES (24074)..(25073): This region may encompass 0-1,000 residues chosen from any of the twenty naturally occurring amino acids; see specification for preferred embodiments
  MOD_RES (25075)..(26074): This region may encompass 0-1,000 residues chosen from any of the twenty naturally occurring amino acids; see specification for preferred embodiments
  MOD_RES (26076)..(27075): This region may encompass 0-1,000 residues chosen from any of the twenty naturally occurring amino acids; see specification for preferred embodiments
  MOD_RES (27077)..(28076): This region may encompass 0-1,000 residues chosen from any of the twenty naturally occurring amino acids; see specification for preferred embodiments
  MOD_RES (28083)..(29082): This region may encompass 0-1,000 residues chosen from any of the twenty naturally occurring amino acids; see specification for preferred embodiments
  MOD_RES (29086)..(30085): This region may encompass 0-1,000 residues chosen from any of the twenty naturally occurring amino acids; see specification for preferred embodiments
  MOD_RES (30116)..(31115): This region may encompass 0-1,000 residues chosen from any of the twenty naturally occurring amino acids; see specification for preferred embodiments
  MOD_RES (31119)..(32118): This region may encompass 0-1,000 residues chosen from any of the twenty naturally occurring amino acids; see specification for preferred embodiments
  MOD_RES (32120)..(33119): This region may encompass 0-1,000 residues chosen from any of the twenty naturally occurring amino acids; see specification for preferred embodiments
  MOD_RES (33122)..(34121): This region may encompass 0-1,000 residues chosen from any of the twenty naturally occurring amino acids; see specification for preferred embodiments
  MOD_RES (34124)..(35123): This region may encompass 0-1,000 residues chosen from any of the twenty naturally occurring amino acids; see specification for preferred embodiments
  MOD_RES (35125)..(36124): This region may encompass 0-1,000 residues chosen from any of the twenty naturally occurring amino acids; see specification for preferred embodiments
  MOD_RES (36128)..(37127): This region may encompass 0-1,000 residues chosen from any of the twenty naturally occurring amino acids; see specification for preferred embodiments
  MOD_RES (37136)..(38135): This region may encompass 0-1,000 residues chosen from any of the twenty naturally occurring amino acids; see specification for preferred embodiments
  MOD_RES (38137)..(39136): This region may encompass 0-1,000 residues chosen from any of the twenty naturally occurring amino acids; see specification for preferred embodiments
  MOD_RES (39144)..(40143): This region may encompass 0-1,000 residues chosen from any of the twenty naturally occurring amino acids; see specification for preferred embodiments
  MOD_RES (40145)..(41144): This region may encompass 0-1,000 residues chosen from any of the twenty naturally occurring amino acids; see specification for preferred embodiments
  MOD_RES (41152)..(42151): This region may encompass 0-1,000 residues chosen from any of the twenty naturally occurring amino acids; see specification for preferred embodiments
  MOD_RES (42154)..(43153): This region may encompass 0-1,000 residues chosen from any of the twenty naturally occurring amino acids; see specification for preferred embodiments
  MOD_RES (43155)..(44154): This region may encompass 0-1,000 residues chosen from any of the twenty naturally occurring amino acids; see specification for preferred embodiments
  MOD_RES (44156)..(45155): This region may encompass 0-1,000 residues chosen from any of the twenty naturally occurring amino acids; see specification for preferred embodiments
  MOD_RES (45157)..(46156): This region may encompass 0-1,000 residues chosen from any of the twenty naturally occurring amino acids; see specification for preferred embodiments
  MOD_RES (46162)..(47161): This region may encompass 0-1,000 residues chosen from any of the twenty naturally occurring amino acids; see specification for preferred embodiments
  MOD_RES (47163)..(48162): This region may encompass 0-1,000 residues chosen from any of the twenty naturally occurring amino acids; see specification for preferred embodiments
  MOD_RES (48164)..(49163): This region may encompass 0-1,000 residues chosen from any of the twenty naturally occurring amino acids; see specification for preferred embodiments
  MOD_RES (49166)..(50165): This region may encompass 0-1,000 residues chosen from any of the twenty naturally occurring amino acids; see specification for preferred embodiments
  MOD_RES (50168)..(51167): This region may encompass 0-1,000 residues chosen from any of the twenty naturally occurring amino acids; see specification for preferred embodiments
  MOD_RES (51169)..(52168): This region may encompass 0-1,000 residues chosen from any of the twenty naturally occurring amino acids; see specification for preferred embodiments
  MOD_RES (52171)..(53170): This region may encompass 0-1,000 residues chosen from any of the twenty naturally occurring amino acids; see specification for preferred embodiments
  MOD_RES (53173)..(54172): This region may encompass 0-1,000 residues chosen from any of the twenty naturally occurring amino acids; see specification for preferred embodiments
  MOD_RES (54175)..(55174): This region may encompass 0-1,000 residues chosen from any of the twenty naturally occurring amino acids; see specification for preferred embodiments
  MOD_RES (55176)..(56175): This region may encompass 0-1,000 residues chosen from any of the twenty naturally occurring amino acids; see specification for preferred embodiments
  MOD_RES (56179)..(57178): This region may encompass 0-1,000 residues chosen from any of the twenty naturally occurring amino acids; see specification for preferred embodiments
  MOD_RES (57181)..(58180): This region may encompass 0-1,000 residues chosen from any of the twenty naturally occurring amino acids; see specification for preferred embodiments
  MOD_RES (58182)..(59181): This region may encompass 0-1,000 residues chosen from any of the twenty naturally occurring amino acids; see specification for preferred embodiments
  MOD_RES (59183)..(60182): This region may encompass 0-1,000 residues chosen from any of the twenty naturally occurring amino acids; see specification for preferred embodiments
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDRGYQFGDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYECAEKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPYTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRGVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVHNFPAGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGVKATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRWLRCDIKSLNLLGAVLAKQEAIEKGCYEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTLYTHPAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRGITRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTCAKEIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEMDEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 1070 - protein, 267 aa, Artificial Sequence
  Description of Artificial Sequence: Synthetic consensus sequence
  MOD_RES (2)..(2): Ser or Thr
  MOD_RES (7)..(7): Gln or Lys
  MOD_RES (10)..(10): Asp or Glu
  MOD_RES (11)..(12): Any amino acid
  MOD_RES (13)..(13): Val or Ile
  MOD_RES (14)..(14): Ile or Val
  MOD_RES (15)..(16): Any amino acid
  MOD_RES (27)..(27): Ile or Val
  MOD_RES (31)..(31): Ile or Val
  MOD_RES (35)..(35): Asn or Asp
  MOD_RES (37)..(37): Met or Leu
  MOD_RES (40)..(41): Any amino acid
  MOD_RES (44)..(44): Ile or Val
  MOD_RES (47)..(47): Any amino acid
  MOD_RES (55)..(55): Arg or Lys
  MOD_RES (56)..(56): Leu, Ile or Val
  MOD_RES (57)..(57): Ile or Val
  MOD_RES (62)..(64): Any amino acid
  MOD_RES (66)..(66): Gln or Lys
  MOD_RES (70)..(70): Any amino acid
  MOD_RES (72)..(72): Val or Ile
  MOD_RES (74)..(74): Any amino acid
  MOD_RES (76)..(76): Leu or Val
  MOD_RES (77)..(77): Any amino acid
  MOD_RES (80)..(80): His or Asn
  MOD_RES (81)..(81): Ile, Val or Leu
  MOD_RES (85)..(85): Ile or Val
  MOD_RES (91)..(91): Any amino acid
  MOD_RES (101)..(101): Val or Ile
  MOD_RES (103)..(103): Any amino acid
  MOD_RES (105)..(105): Leu or Ile
  MOD_RES (109)..(109): Any amino acid
  MOD_RES (111)..(111): Any amino acid
  MOD_RES (113)..(113): Any amino acid
  MOD_RES (115)..(117): Any amino acid
  MOD_RES (119)..(119): Glu or Gln
  MOD_RES (126)..(126): Any amino acid
  MOD_RES (130)..(130): Ile or Val
  MOD_RES (161)..(161): Ile or Val
  MOD_RES (165)..(165): Any amino acid
  MOD_RES (167)..(167): Val or Ile
  MOD_RES (170)..(170): Any amino acid
  MOD_RES (173)..(173): Any amino acid
  MOD_RES (175)..(175): Val or Ile
  MOD_RES (176)..(176): Phe or Tyr
  MOD_RES (180)..(180): Asp or Asn
  MOD_RES (189)..(189): Asn or Asp
  MOD_RES (191)..(191): Any amino acid
  MOD_RES (199)..(199): Any amino acid
  MOD_RES (201)..(201): Ile or Val
  MOD_RES (202)..(202): Leu or Ile
  MOD_RES (210)..(210): Leu, Met or Ile
  MOD_RES (213)..(213): Glu or Gln
  MOD_RES (215)..(216): Any amino acid
  MOD_RES (218)..(218): Any amino acid
  MOD_RES (220)..(221): Any amino acid
  MOD_RES (227)..(227): Leu, Ile, Val or Met
  MOD_RES (228)..(228): Any amino acid
  MOD_RES (230)..(230): Ser or Thr
  MOD_RES (232)..(232): Thr or Ser
  MOD_RES (235)..(235): Ile or Val
  MOD_RES (238)..(238): Val or Ile
  MOD_RES (240)..(240): Asp or Glu
  MOD_RES (241)..(241): Ile, Val or Leu
  MOD_RES (244)..(244): Any amino acid
  MOD_RES (247)..(247): Any amino acid
  MOD_RES (250)..(251): Any amino acid
  MOD_RES (253)..(253): Glu or Asp
  MOD_RES (257)..(257): Lys or Gln
  MOD_RES (260)..(261): Any amino acid
  MOD_RES (263)..(264): Any amino acid
  MOD_RES (266)..(266): Ile or Leu
YXLWNDXIVXXXXXXXEDRGYQFGDGXYEVXKVYXGXFTXXEHXDRXYECAEKIXXXPYTKXXXHXLLHXLXEXNXXTGXXYFQXTRGVAXRVHNFPAGNXQXVXSGTXKXFXRXXXNXKGVKATXTEDXRWLRCDIKSLNLLGAVLAKQEAIEKGCYEAXLHRXGXTEXSSXNXXGIKXGTLYTHPAXNXILRGITRXVXXTCAKEIEXPVXQXXTXKXXLEMDEXXVXSXSEXTPXIXXDGXKIXNGXXGXWTRXLQXXFXXKXP

SEQ ID NO: 1071 - protein, 49105 aa, Artificial Sequence
  Description of Artificial Sequence: Synthetic consensus sequence
  MOD_RES (2)..(1001): This region may encompass 0-1,000 residues chosen from any of the twenty naturally occurring  amino acids; see specification for preferred embodiments
  MOD_RES (1007)..(2006): This region may encompass 0-1,000 residues chosen from any of the twenty naturally occurring  amino acids; see specification for preferred embodiments
  MOD_RES (2008)..(3007): This region may encompass 0-1,000 residues chosen from any of the twenty naturally occurring  amino acids; see specification for preferred embodiments
  MOD_RES (3010)..(4009): This region may encompass 0-1,000 residues chosen from any of the twenty naturally occurring  amino acids; see specification for preferred embodiments
  MOD_RES (4014)..(5013): This region may encompass 0-1,000 residues chosen from any of the twenty naturally occurring  amino acids; see specification for preferred embodiments
  MOD_RES (5018)..(6017): This region may encompass 0-1,000 residues chosen from any of the twenty naturally occurring  amino acids; see specification for preferred embodiments
  MOD_RES (6019)..(7018): This region may encompass 0-1,000 residues chosen from any of the twenty naturally occurring  amino acids; see specification for preferred embodiments
  MOD_RES (7022)..(8021): This region may encompass 0-1,000 residues chosen from any of the twenty naturally occurring  amino acids; see specification for preferred embodiments
  MOD_RES (8023)..(9022): This region may encompass 0-1,000 residues chosen from any of the twenty naturally occurring  amino acids; see specification for preferred embodiments
  MOD_RES (9025)..(10024): This region may encompass 0-1,000 residues chosen from any of the twenty naturally occurring  amino acids; see specification for preferred embodiments
  MOD_RES (10027)..(11026): This region may encompass 0-1,000 residues chosen from any of the twenty naturally occurring  amino acids; see specification for preferred embodiments
  MOD_RES (11029)..(12028): This region may encompass 0-1,000 residues chosen from any of the twenty naturally occurring  amino acids; see specification for preferred embodiments
  MOD_RES (12030)..(13029): This region may encompass 0-1,000 residues chosen from any of the twenty naturally occurring  amino acids; see specification for preferred embodiments
  MOD_RES (13031)..(14030): This region may encompass 0-1,000 residues chosen from any of the twenty naturally occurring  amino acids; see specification for preferred embodiments
  MOD_RES (14034)..(15033): This region may encompass 0-1,000 residues chosen from any of the twenty naturally occurring  amino acids; see specification for preferred embodiments
  MOD_RES (15036)..(16035): This region may encompass 0-1,000 residues chosen from any of the twenty naturally occurring  amino acids; see specification for preferred embodiments
  MOD_RES (16037)..(17036): This region may encompass 0-1,000 residues chosen from any of the twenty naturally occurring  amino acids; see specification for preferred embodiments
  MOD_RES (17038)..(18037): This region may encompass 0-1,000 residues chosen from any of the twenty naturally occurring  amino acids; see specification for preferred embodiments
  MOD_RES (18039)..(19038): This region may encompass 0-1,000 residues chosen from any of the twenty naturally occurring  amino acids; see specification for preferred embodiments
  MOD_RES (19040)..(20039): This region may encompass 0-1,000 residues chosen from any of the twenty naturally occurring  amino acids; see specification for preferred embodiments
  MOD_RES (20041)..(21040): This region may encompass 0-1,000 residues chosen from any of the twenty naturally occurring  amino acids; see specification for preferred embodiments
  MOD_RES (21042)..(22041): This region may encompass 0-1,000 residues chosen from any of the twenty naturally occurring  amino acids; see specification for preferred embodiments
  MOD_RES (22043)..(23042): This region may encompass 0-1,000 residues chosen from any of the twenty naturally occurring  amino acids; see specification for preferred embodiments
  MOD_RES (23046)..(24045): This region may encompass 0-1,000 residues chosen from any of the twenty naturally occurring  amino acids; see specification for preferred embodiments
  MOD_RES (24050)..(25049): This region may encompass 0-1,000 residues chosen from any of the twenty naturally occurring  amino acids; see specification for preferred embodiments
  MOD_RES (25059)..(26058): This region may encompass 0-1,000 residues chosen from any of the twenty naturally occurring  amino acids; see specification for preferred embodiments
  MOD_RES (26060)..(27059): This region may encompass 0-1,000 residues chosen from any of the twenty naturally occurring  amino acids; see specification for preferred embodiments
  MOD_RES (27063)..(28062): This region may encompass 0-1,000 residues chosen from any of the twenty naturally occurring  amino acids; see specification for preferred embodiments
  MOD_RES (28064)..(29063): This region may encompass 0-1,000 residues chosen from any of the twenty naturally occurring  amino acids; see specification for preferred embodiments
  MOD_RES (29065)..(30064): This region may encompass 0-1,000 residues chosen from any of the twenty naturally occurring  amino acids; see specification for preferred embodiments
  MOD_RES (30066)..(31065): This region may encompass 0-1,000 residues chosen from any of the twenty naturally occurring  amino acids; see specification for preferred embodiments
  MOD_RES (31067)..(32066): This region may encompass 0-1,000 residues chosen from any of the twenty naturally occurring  amino acids; see specification for preferred embodiments
  MOD_RES (32072)..(33071): This region may encompass 0-1,000 residues chosen from any of the twenty naturally occurring  amino acids; see specification for preferred embodiments
  MOD_RES (33080)..(34079): This region may encompass 0-1,000 residues chosen from any of the twenty naturally occurring  amino acids; see specification for preferred embodiments
  MOD_RES (34081)..(35080): This region may encompass 0-1,000 residues chosen from any of the twenty naturally occurring  amino acids; see specification for preferred embodiments
  MOD_RES (35085)..(36084): This region may encompass 0-1,000 residues chosen from any of the twenty naturally occurring  amino acids; see specification for preferred embodiments
  MOD_RES (36086)..(37085): This region may encompass 0-1,000 residues chosen from any of the twenty naturally occurring  amino acids; see specification for preferred embodiments
  MOD_RES (37088)..(38087): This region may encompass 0-1,000 residues chosen from any of the twenty naturally occurring  amino acids; see specification for preferred embodiments
  MOD_RES (38089)..(39088): This region may encompass 0-1,000 residues chosen from any of the twenty naturally occurring  amino acids; see specification for preferred embodiments
  MOD_RES (39090)..(40089): This region may encompass 0-1,000 residues chosen from any of the twenty naturally occurring  amino acids; see specification for preferred embodiments
  MOD_RES (40091)..(41090): This region may encompass 0-1,000 residues chosen from any of the twenty naturally occurring  amino acids; see specification for preferred embodiments
  MOD_RES (41092)..(42091): This region may encompass 0-1,000 residues chosen from any of the twenty naturally occurring  amino acids; see specification for preferred embodiments
  MOD_RES (42095)..(43094): This region may encompass 0-1,000 residues chosen from any of the twenty naturally occurring  amino acids; see specification for preferred embodiments
  MOD_RES (43096)..(44095): This region may encompass 0-1,000 residues chosen from any of the twenty naturally occurring  amino acids; see specification for preferred embodiments
  MOD_RES (44098)..(45097): This region may encompass 0-1,000 residues chosen from any of the twenty naturally occurring  amino acids; see specification for preferred embodiments
  MOD_RES (45100)..(46099): This region may encompass 0-1,000 residues chosen from any of the twenty naturally occurring  amino acids; see specification for preferred embodiments
  MOD_RES (46103)..(47102): This region may encompass 0-1,000 residues chosen from any of the twenty naturally occurring  amino acids; see specification for preferred embodiments
  MOD_RES (47104)..(48103): This region may encompass 0-1,000 residues chosen from any of the twenty naturally occurring  amino acids; see specification for preferred embodiments
  MOD_RES (48105)..(49104): This region may encompass 0-1,000 residues chosen from any of the twenty naturally occurring  amino acids; see specification for preferred embodiments
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYYNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFGDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYDATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYWQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHCNIKTLNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTECAHSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 1072 - protein, 279 aa, Artificial Sequence
  Description of Artificial Sequence: Synthetic consensus sequence
  MOD_RES (2)..(4): Any amino acid
  MOD_RES (10)..(19): Any amino acid
  MOD_RES (21)..(22): Any amino acid
  MOD_RES (25)..(27): Any amino acid
  MOD_RES (32)..(32): Any amino acid
  MOD_RES (37)..(39): Any amino acid
  MOD_RES (41)..(43): Any amino acid
  MOD_RES (47)..(48): Any amino acid
  MOD_RES (50)..(51): Any amino acid
  MOD_RES (54)..(54): Any amino acid
  MOD_RES (57)..(58): Any amino acid
  MOD_RES (61)..(61): Any amino acid
  MOD_RES (63)..(71): Any amino acid
  MOD_RES (73)..(89): Any amino acid
  MOD_RES (93)..(94): Any amino acid
  MOD_RES (97)..(97): Any amino acid
  MOD_RES (99)..(99): Any amino acid
  MOD_RES (101)..(101): Any amino acid
  MOD_RES (103)..(103): Any amino acid
  MOD_RES (105)..(111): This region may encompass 5 or 7 residues chosen from any of the twenty naturally occurring  amino acids
  MOD_RES (113)..(114): Any amino acid
  MOD_RES (116)..(118): Any amino acid
  MOD_RES (120)..(129): Any amino acid
  MOD_RES (133)..(135): Any amino acid
  MOD_RES (140)..(140): Any amino acid
  MOD_RES (150)..(150): Any amino acid
  MOD_RES (152)..(152): Any amino acid
  MOD_RES (156)..(156): Any amino acid
  MOD_RES (158)..(160): Any amino acid
  MOD_RES (162)..(163): Any amino acid
  MOD_RES (165)..(165): Any amino acid
  MOD_RES (167)..(167): Any amino acid
  MOD_RES (173)..(174): Any amino acid
  MOD_RES (183)..(184): Any amino acid
  MOD_RES (186)..(196): Any amino acid
  MOD_RES (202)..(202): Any amino acid
  MOD_RES (204)..(207): Any amino acid
  MOD_RES (210)..(218): Any amino acid
  MOD_RES (220)..(221): Any amino acid
  MOD_RES (223)..(224): Any amino acid
  MOD_RES (226)..(229): Any amino acid
  MOD_RES (231)..(232): Any amino acid
  MOD_RES (236)..(237): Any amino acid
  MOD_RES (239)..(239): Any amino acid
  MOD_RES (242)..(251): Any amino acid
  MOD_RES (254)..(256): Any amino acid
  MOD_RES (260)..(264): Any amino acid
  MOD_RES (266)..(267): Any amino acid
  MOD_RES (269)..(278): Any amino acid
MXXXGYYNGXXXXXXXXXXPXXDRXXXFGDGXYDATXXXNXXXFALXXHXXRFXNSXXLLXIXXXXXXXXXKXXXXXXXXXXXXXXXXXYWQXXRGXGXRXHXFXXXXXXXNXXIXXXPXXXXXXXXXXKLIXXXDTRFXHCNIKTLNLXPXVIAXQXXXEXXCXEXVFHRGXXVTECAHSNXXIXXXXXXXXXXXDNLILXGXXXXHLXXXXXXXXXPXXEXXFXXXXLXXADEXXVXSSXXXXXXXXXXDGXXXGGKXXXXXKXXQXXXXXXXXXXT

SEQ ID NO: 1073 - protein, 1155 aa, Artificial Sequence
  Description of Artificial Sequence: Synthetic consensus sequence
  MOD_RES (2)..(21): This region may encompass 0-20 residues chosen from any of the twenty naturally occurring  amino acids; see specification for preferred embodiments
  MOD_RES (22)..(22): Leu or Val
  MOD_RES (28)..(47): This region may encompass 0-20 residues chosen from any of the twenty naturally occurring  amino acids; see specification for preferred embodiments
  MOD_RES (48)..(48): Leu or Ile
  MOD_RES (49)..(68): This region may encompass 0-20 residues chosen from any of the twenty naturally occurring  amino acids; see specification for preferred embodiments
  MOD_RES (69)..(69): Met or Leu
  MOD_RES (70)..(89): This region may encompass 0-20 residues chosen from any of the twenty naturally occurring  amino acids; see specification for preferred embodiments
  MOD_RES (90)..(90): Val or Ile
  MOD_RES (92)..(111): This region may encompass 0-20 residues chosen from any of the twenty naturally occurring  amino acids; see specification for preferred embodiments
  MOD_RES (114)..(133): This region may encompass 0-20 residues chosen from any of the twenty naturally occurring  amino acids; see specification for preferred embodiments
  MOD_RES (134)..(134): Tyr or Phe
  MOD_RES (139)..(158): This region may encompass 0-20 residues chosen from any of the twenty naturally occurring  amino acids; see specification for preferred embodiments
  MOD_RES (163)..(182): This region may encompass 0-20 residues chosen from any of the twenty naturally occurring  amino acids; see specification for preferred embodiments
  MOD_RES (184)..(203): This region may encompass 0-20 residues chosen from any of the twenty naturally occurring  amino acids; see specification for preferred embodiments
  MOD_RES (207)..(207): Asp or Glu
  MOD_RES (208)..(208): Glu or Asp
  MOD_RES (210)..(210): Ile or Leu
  MOD_RES (211)..(211): Asp or Glu
  MOD_RES (214)..(233): This region may encompass 0-20 residues chosen from any of the twenty naturally occurring  amino acids; see specification for preferred embodiments
  MOD_RES (236)..(255): This region may encompass 0-20 residues chosen from any of the twenty naturally occurring  amino acids; see specification for preferred embodiments
  MOD_RES (258)..(277): This region may encompass 0-20 residues chosen from any of the twenty naturally occurring  amino acids; see specification for preferred embodiments
  MOD_RES (279)..(298): This region may encompass 0-20 residues chosen from any of the twenty naturally occurring  amino acids; see specification for preferred embodiments
  MOD_RES (299)..(299): Lys or Arg
  MOD_RES (300)..(319): This region may encompass 0-20 residues chosen from any of the twenty naturally occurring  amino acids; see specification for preferred embodiments
  MOD_RES (320)..(320): Glu or Gln
  MOD_RES (321)..(321): Leu, Met or Val
  MOD_RES (323)..(323): Lys or Glu
  MOD_RES (324)..(343): This region may encompass 0-20 residues chosen from any of the twenty naturally occurring  amino acids; see specification for preferred embodiments
  MOD_RES (344)..(344): Met or Val
  MOD_RES (345)..(364): This region may encompass 0-20 residues chosen from any of the twenty naturally occurring  amino acids; see specification for preferred embodiments
  MOD_RES (365)..(365): Asp or Glu
  MOD_RES (366)..(385): This region may encompass 0-20 residues chosen from any of the twenty naturally occurring  amino acids; see specification for preferred embodiments
  MOD_RES (386)..(386): Val or Leu
  MOD_RES (390)..(409): This region may encompass 0-20 residues chosen from any of the twenty naturally occurring  amino acids; see specification for preferred embodiments
  MOD_RES (410)..(410): Thr or Ser
  MOD_RES (413)..(413): Thr or Ser
  MOD_RES (415)..(434): This region may encompass 0-20 residues chosen from any of the twenty naturally occurring  amino acids; see specification for preferred embodiments
  MOD_RES (436)..(436): Asn or Ser
  MOD_RES (438)..(457): This region may encompass 0-20 residues chosen from any of the twenty naturally occurring  amino acids; see specification for preferred embodiments
  MOD_RES (459)..(478): This region may encompass 0-20 residues chosen from any of the twenty naturally occurring  amino acids; see specification for preferred embodiments
  MOD_RES (480)..(480): Leu or Ile
  MOD_RES (481)..(500): This region may encompass 0-20 residues chosen from any of the twenty naturally occurring  amino acids; see specification for preferred embodiments
  MOD_RES (502)..(521): This region may encompass 0-20 residues chosen from any of the twenty naturally occurring  amino acids; see specification for preferred embodiments
  MOD_RES (523)..(542): This region may encompass 0-20 residues chosen from any of the twenty naturally occurring  amino acids; see specification for preferred embodiments
  MOD_RES (543)..(543): Ile, Val or Leu
  MOD_RES (544)..(563): This region may encompass 0-20 residues chosen from any of the twenty naturally occurring  amino acids; see specification for preferred embodiments
  MOD_RES (564)..(564): Lys or Glu
  MOD_RES (565)..(584): This region may encompass 0-20 residues chosen from any of the twenty naturally occurring  amino acids; see specification for preferred embodiments
  MOD_RES (588)..(588): Thr or Ser
  MOD_RES (589)..(608): This region may encompass 0-20 residues chosen from any of the twenty naturally occurring  amino acids; see specification for preferred embodiments
  MOD_RES (609)..(609): Glu or Asp
  MOD_RES (614)..(633): This region may encompass 0-20 residues chosen from any of the twenty naturally occurring  amino acids; see specification for preferred embodiments
  MOD_RES (643)..(643): Ile or Leu
  MOD_RES (645)..(645): Asn or Ser
  MOD_RES (649)..(649): Ser or Ala
  MOD_RES (651)..(651): Arg or Lys
  MOD_RES (652)..(671): This region may encompass 0-20 residues chosen from any of the twenty naturally occurring  amino acids; see specification for preferred embodiments
  MOD_RES (673)..(692): This region may encompass 0-20 residues chosen from any of the twenty naturally occurring  amino acids; see specification for preferred embodiments
  MOD_RES (694)..(713): This region may encompass 0-20 residues chosen from any of the twenty naturally occurring  amino acids; see specification for preferred embodiments
  MOD_RES (715)..(734): This region may encompass 0-20 residues chosen from any of the twenty naturally occurring  amino acids; see specification for preferred embodiments
  MOD_RES (740)..(740): Glu or Asp
  MOD_RES (741)..(760): This region may encompass 0-20 residues chosen from any of the twenty naturally occurring  amino acids; see specification for preferred embodiments
  MOD_RES (769)..(769): Val or Ile
  MOD_RES (770)..(789): This region may encompass 0-20 residues chosen from any of the twenty naturally occurring  amino acids; see specification for preferred embodiments
  MOD_RES (791)..(791): Ile or Leu
  MOD_RES (792)..(792): Lys or Arg
  MOD_RES (793)..(793): Asn or Asp
  MOD_RES (794)..(813): This region may encompass 0-20 residues chosen from any of the twenty naturally occurring  amino acids; see specification for preferred embodiments
  MOD_RES (814)..(814): Thr or Ser
  MOD_RES (815)..(834): This region may encompass 0-20 residues chosen from any of the twenty naturally occurring  amino acids; see specification for preferred embodiments
  MOD_RES (840)..(859): This region may encompass 0-20 residues chosen from any of the twenty naturally occurring  amino acids; see specification for preferred embodiments
  MOD_RES (861)..(880): This region may encompass 0-20 residues chosen from any of the twenty naturally occurring  amino acids; see specification for preferred embodiments
  MOD_RES (883)..(883): Leu or Ile
  MOD_RES (884)..(884): Gln or Lys
  MOD_RES (885)..(904): This region may encompass 0-20 residues chosen from any of the twenty naturally occurring  amino acids; see specification for preferred embodiments
  MOD_RES (905)..(905): Ile or Val
  MOD_RES (907)..(926): This region may encompass 0-20 residues chosen from any of the twenty naturally occurring  amino acids; see specification for preferred embodiments
  MOD_RES (928)..(947): This region may encompass 0-20 residues chosen from any of the twenty naturally occurring  amino acids; see specification for preferred embodiments
  MOD_RES (949)..(949): Thr or Ser
  MOD_RES (950)..(950): Leu or Met
  MOD_RES (951)..(970): This region may encompass 0-20 residues chosen from any of the twenty naturally occurring  amino acids; see specification for preferred embodiments
  MOD_RES (971)..(971): Glu or Asp
  MOD_RES (973)..(992): This region may encompass 0-20 residues chosen from any of the twenty naturally occurring  amino acids; see specification for preferred embodiments
  MOD_RES (996)..(996): Val or Ile
  MOD_RES (997)..(997): Leu or Ile
  MOD_RES (999)..(999): Ser or Thr
  MOD_RES (1002)..(1021): This region may encompass 0-20 residues chosen from any of the twenty naturally occurring  amino acids; see specification for preferred embodiments
  MOD_RES (1022)..(1022): Leu, Met or Ile
  MOD_RES (1023)..(1042): This region may encompass 0-20 residues chosen from any of the twenty naturally occurring  amino acids; see specification for preferred embodiments
  MOD_RES (1043)..(1043): Ile or Leu
  MOD_RES (1046)..(1065): This region may encompass 0-20 residues chosen from any of the twenty naturally occurring  amino acids; see specification for preferred embodiments
  MOD_RES (1069)..(1088): This region may encompass 0-20 residues chosen from any of the twenty naturally occurring  amino acids; see specification for preferred embodiments
  MOD_RES (1089)..(1089): Leu, Val or Ile
  MOD_RES (1091)..(1110): This region may encompass 0-20 residues chosen from any of the twenty naturally occurring  amino acids; see specification for preferred embodiments
  MOD_RES (1111)..(1111): Ile or Leu
  MOD_RES (1113)..(1132): This region may encompass 0-20 residues chosen from any of the twenty naturally occurring  amino acids; see specification for preferred embodiments
  MOD_RES (1133)..(1133): Glu or Lys
  MOD_RES (1134)..(1134): Phe or Tyr
  MOD_RES (1135)..(1154): This region may encompass 0-20 residues chosen from any of the twenty naturally occurring  amino acids; see specification for preferred embodiments
MXXXXXXXXXXXXXXXXXXXXXGYYNGXXXXXXXXXXXXXXXXXXXXXXXXXXXXXXXXXXXXXXXXXXXXXXXXXXXXXXXXXXXXXXXPXXXXXXXXXXXXXXXXXXXXDRXXXXXXXXXXXXXXXXXXXXXFGDGXXXXXXXXXXXXXXXXXXXXYDATXXXXXXXXXXXXXXXXXXXXNXXXXXXXXXXXXXXXXXXXXFALXXHXXRFXXXXXXXXXXXXXXXXXXXXNSXXXXXXXXXXXXXXXXXXXXLLXXXXXXXXXXXXXXXXXXXXIXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXYWQXXXXXXXXXXXXXXXXXXXXXRGXGXXXXXXXXXXXXXXXXXXXXRXHXXXXXXXXXXXXXXXXXXXXFXXXXXXXXXXXXXXXXXXXXNXXXXXXXXXXXXXXXXXXXXXIXXXXXXXXXXXXXXXXXXXXPXXXXXXXXXXXXXXXXXXXXXXXXXXXXXXXXXXXXXXXXXXXXXXXXXXXXXXXXXXXXXXKLIXXXXXXXXXXXXXXXXXXXXXXDTRFXXXXXXXXXXXXXXXXXXXXHCNIKTLNLXPXVIAXQXXXXXXXXXXXXXXXXXXXXXEXXXXXXXXXXXXXXXXXXXXCXXXXXXXXXXXXXXXXXXXXEXXXXXXXXXXXXXXXXXXXXVFHRGXXXXXXXXXXXXXXXXXXXXXVTECAHSNXXXXXXXXXXXXXXXXXXXXXIXXXXXXXXXXXXXXXXXXXXXXXXXXXXXXXXXXXXXXXXXXXXDNLILXXXXXXXXXXXXXXXXXXXXGXXXXXXXXXXXXXXXXXXXXHLXXXXXXXXXXXXXXXXXXXXXXXPXXXXXXXXXXXXXXXXXXXXEXXXXXXXXXXXXXXXXXXXXFXXXXXXXXXXXXXXXXXXXXXXXLXXXXXXXXXXXXXXXXXXXXADEXXVXSSXXXXXXXXXXXXXXXXXXXXXXXXXXXXXXXXXXXXXXXXXXDGXXXXXXXXXXXXXXXXXXXXGGKXXXXXXXXXXXXXXXXXXXXXKXXXXXXXXXXXXXXXXXXXXXQXXXXXXXXXXXXXXXXXXXXXXXXXXXXXXXXXXXXXXXXXXT

SEQ ID NO: 1074 - DNA, 38 bp, Artificial Sequence
  Oligonucleotide
ctaacggagtgatctttgctctagacgagcacattgac

SEQ ID NO: 1075 - DNA, 38 bp, Artificial Sequence
  Oligonucleotide
gtcaatgtgctcgtctagagcaaagatcactccgttag

SEQ ID NO: 1076 - DNA, 39 bp, Artificial Sequence
  Oligonucleotide
catggaagatacacgattcctccactgcaacatcaagac

SEQ ID NO: 1077 - DNA, 39 bp, Artificial Sequence
  Oligonucleotide
gtcttgatgttgcagtggaggaatcgtgtatcttccatg

SEQ ID NO: 1078 - DNA, 37 bp, Artificial Sequence
  Oligonucleotide
attgcctcccagcgggctctagaagcgggctgccacg

SEQ ID NO: 1079 - DNA, 37 bp, Artificial Sequence
  Oligonucleotide
cgtggcagcccgcttctagagcccgctgggaggcaat

SEQ ID NO: 1080 - DNA, 38 bp, Artificial Sequence
  Oligonucleotide
ggggggaaaagctcccgaactgctaaaaaaaattcagg

SEQ ID NO: 1081 - DNA, 38 bp, Artificial Sequence
  Oligonucleotide
cctgaattttttttagcaggtcgggagcttttcccccc

SEQ ID NO: 1082 - DNA, 32 bp, Artificial Sequence
  Oligonucleotide
cgcagaattcggacgcactgggatattacaac

SEQ ID NO: 1083 - DNA, 32 bp, Artificial Sequence
  Oligonucleotide
gttagcggccgcctatactgtgctccactcag

SEQ ID NO: 1084 - DNA, 33 bp, Artificial Sequence
  Oligonucleotide
atggacgcactgggatgttacaacggaaattgg

SEQ ID NO: 1085 - DNA, 33 bp, Artificial Sequence
  Oligonucleotide
ccaatttccgttgtaacatcccagtgcgtccat

SEQ ID NO: 1086 - DNA, 36 bp, Artificial Sequence
  Oligonucleotide
atggacgcactgggactttacaacggaaattggggg

SEQ ID NO: 1087 - DNA, 36 bp, Artificial Sequence
  Oligonucleotide
cccccaatttccgttgtaaagtcccagtgcgtccat

SEQ ID NO: 1088 - DNA, 39 bp, Artificial Sequence
  Oligonucleotide
tacctggtttattggcagggtactcgcggaacaggccgg

SEQ ID NO: 1089 - DNA, 39 bp, Artificial Sequence
  Oligonucleotide
ccggcctgttccgcgagtaccctgccaataaaccaggta

SEQ ID NO: 1090 - DNA, 44 bp, Artificial Sequence
  Oligonucleotide
ctctggattataattaagcccggccacatcgacaatctttatag

SEQ ID NO: 1091 - DNA, 44 bp, Artificial Sequence
  Oligonucleotide
ctataaagattgtcgatgtggccgggcttaattataatccagag

SEQ ID NO: 1092 - DNA, 44 bp, Artificial Sequence
  Oligonucleotide
ctctggattataattaagcccaggcacatcgacaatctttatag

SEQ ID NO: 1093 - DNA, 44 bp, Artificial Sequence
  Oligonucleotide
ctataaagattgtcgatgtgcctgggcttaattataatccagag

SEQ ID NO: 1094 - DNA, 44 bp, Artificial Sequence
  Oligonucleotide
gtatttccggcaggcccttcagcgctctggattataattaagcc

SEQ ID NO: 1095 - DNA, 44 bp, Artificial Sequence
  Oligonucleotide
ggcttaattataatccagagcgctgaagggcctgccggaaatac

SEQ ID NO: 1096 - DNA, 46 bp, Artificial Sequence
  Oligonucleotide
caatctttatagaaaaatcaaggttattaccatggatgatacccgc

SEQ ID NO: 1097 - DNA, 45 bp, Artificial Sequence
  Oligonucleotide
gcgggtatgatccatggtaataaccttgatttttctataaagatt

SEQ ID NO: 1098 - DNA, 46 bp, Artificial Sequence
  Oligonucleotide
cttaacaaaagaggaattgaaactgactttaaatgaaatgtactcc

SEQ ID NO: 1099 - DNA, 46 bp, Artificial Sequence
  Oligonucleotide
ggagtacatttcatttaaagtcagtttcaattcctcttttgttaag

SEQ ID NO: 1100 - DNA, 43 bp, Artificial Sequence
  Oligonucleotide
ttcgacgcggacgaggtgcttacttccagcagcggcacactcg

SEQ ID NO: 1101 - DNA, 43 bp, Artificial Sequence
  Oligonucleotide
cgagtgtgccgctgctggaagtaagcacctcgtccgcgtcgaa

SEQ ID NO: 1102 - DNA, 39 bp, Artificial Sequence
  Oligonucleotide
tgcttgtgtccagcagcggccggctcggccttagcgccg

SEQ ID NO: 1103 - DNA, 39 bp, Artificial Sequence
  Oligonucleotide
cggcgctaaggccgagccggccgctgctggacacaagca

SEQ ID NO: 1104 - DNA, 42 bp, Artificial Sequence
  Oligonucleotide
ctggacgagatgactgtgagtatgaacgacaggggctgctac

SEQ ID NO: 1105 - DNA, 39 bp, Artificial Sequence; identical to SEQ ID NO: 1102
  Oligonucleotide

SEQ ID NO: 1106 - DNA, 50 bp, Artificial Sequence
  Oligonucleotide
ctaaaaaaaatccaggatgaagtgtggagggaatttatcgaagcgacagg

SEQ ID NO: 1107 - DNA, 41 bp, Artificial Sequence
  Oligonucleotide
caaaagaggaattgaaaaaagtgttaaatgaaatgtactcc

SEQ ID NO: 1108 - DNA, 41 bp, Artificial Sequence
  Oligonucleotide
ggagtacatttcatttaacacttttttcaattcctcttttg

SEQ ID NO: 1109 - DNA, 46 bp, Artificial Sequence; identical to SEQ ID NO: 1098
  Oligonucleotide

SEQ ID NO: 1110 - DNA, 46 bp, Artificial Sequence; identical to SEQ ID NO: 1099
  Oligonucleotide

SEQ ID NO: 1111 - DNA, 42 bp, Artificial Sequence; identical to SEQ ID NO: 1104
  Oligonucleotide

SEQ ID NO: 1112 - DNA, 42 bp, Artificial Sequence
  Oligonucleotide
gtagcagcccctgtcgttcatactcacagtcatctcgtccag

SEQ ID NO: 1113 - DNA, 42 bp, Artificial Sequence; identical to SEQ ID NO: 1104
  Oligonucleotide

SEQ ID NO: 1114 - DNA, 42 bp, Artificial Sequence; identical to SEQ ID NO: 1112
  Oligonucleotide

SEQ ID NO: 1115 - DNA, 41 bp, Artificial Sequence; identical to SEQ ID NO: 1107
  Oligonucleotide

SEQ ID NO: 1116 - DNA, 43 bp, Artificial Sequence; identical to SEQ ID NO: 1100
  Oligonucleotide

SEQ ID NO: 1117 - DNA, 39 bp, Artificial Sequence; identical to SEQ ID NO: 1102
  Oligonucleotide

SEQ ID NO: 1118 - DNA, 39 bp, Artificial Sequence; identical to SEQ ID NO: 1088
  Oligonucleotide

SEQ ID NO: 1119 - DNA, 39 bp, Artificial Sequence; identical to SEQ ID NO: 1089
  Oligonucleotide

SEQ ID NO: 1120 - DNA, 39 bp, Artificial Sequence; identical to SEQ ID NO: 1088
  Oligonucleotide

SEQ ID NO: 1121 - DNA, 39 bp, Artificial Sequence; identical to SEQ ID NO: 1102
  Oligonucleotide

SEQ ID NO: 1122 - DNA, 41 bp, Artificial Sequence; identical to SEQ ID NO: 1107
  Oligonucleotide

SEQ ID NO: 1123 - DNA, 41 bp, Artificial Sequence; identical to SEQ ID NO: 1108
  Oligonucleotide

SEQ ID NO: 1124 - DNA, 42 bp, Artificial Sequence; identical to SEQ ID NO: 1104
  Oligonucleotide

SEQ ID NO: 1125 - DNA, 39 bp, Artificial Sequence; identical to SEQ ID NO: 1102
  Oligonucleotide

SEQ ID NO: 1126 - protein, 284 aa, Artificial Sequence
  Chemically synthesized
MAYSLWNDQIVEEGSIAISPEDRGYQFGDGIYEVIKVYNGNMFTAQEHIDRFYASAEKIRLVIPYTKDVLHKLLHELIEKNNLETGHVYFQITRGANSRNHVFPDASIPAVLTGNVKAGERAYENFEKGVKATFVEDIRWLRCDIKSLNLLGAVLAKQEAAEKGCYEAILHRGDIVTECSSANVYGIKDGKLYTHPANNFILNGITRQVILKCAEEINLPVIEEPMTKADLLTMDEIIVSSVSSEVTPVIDVDGNQIGAGVPGEWTRQLQQSFEAKLPLSMNTK

SEQ ID NO: 1127 - protein, 283 aa, Artificial Sequence
  Chemically synthesized
MAYSLWNDQIVEEGSITISPEDRGYQFGDGIYEVIKVYNGHMFTAQEHIDRFYASAEKIRLVIPYTKDVLHKLLHDLIEKNNLNTGHVYFQITRGTTSRNHIFPDASVPAVLTGNVKTGERSIENFEKGVKATLVEDVRWLRCDIKSLNLLGAVLAKQEASEKGCYEAILHRGDIITECSSANVYGIKDGKLYTHPANNYILNGITRQVILKCAAEINLPVIEEPMTKGDLLTMDEIIVSSVSSEVTPVIDVDGQQIGAGVPGEWTRKLQKAFEAKLPISINA

SEQ ID NO: 1128 - protein, 283 aa, Artificial Sequence
  Chemically synthesized
MGYTLWNDQIVEDGSVSISPEDRGYQFGDGVYEVVKVYNGNMFTVNEHIDRLYASAEKIRIVIPYTKDVFHKLLHELVEKNNLNTGHIYFQVTRGTSSRAHVFPEATVPAVITGNVKSGERALENLEKGVKATFVEDIRWLRCDIKSLNLLGAVLAKQEASEKGCYEAILHRGDIVTECSSSNVFGIKDGKLYTHPANNLILNGITRQVVIKCAEEINIPVVEEPFTKGEILTMDELFVTSVTSEITPVIEIDGNQIGAGVPGEWTRKLQKAFEAKIPLSLNS

SEQ ID NO: 1129 - protein, 283 aa, Artificial Sequence
  Chemically synthesized
MSYSLWNDQIVNDEEVVVDKEDRGYQFGDGVYEVVKVYNGELFTAEEHVDRFYASAEKIRVTIPYTKDKLHQLLHQLVEMNKVQTGHIYFQITRGAGPRNHIFPGDEVKPVLTGNTKENPRPVANFEKGVKATFVEDIRWLRCDIKSLNLLGAVLAKQEAHEKGCYEAVLHRDEIVTEGSSSNIYGIKDGVLYTHPANNFILNGITRQVIIKCAAEIGLPVKEEAMTKTQLLAMDEVIVSSTTSEVTPIIDIDGTVIGAGKPGDWTRKLQAQFDTKIPKGIRA

SEQ ID NO: 1130 - protein, 283 aa, Artificial Sequence
  Chemically synthesized
MGYTLWNDQIVKDEEVKIDKEDRGYQFGDGVYEVVKVYNGEMFTVNEHIDRLYASAEKIRITIPYTKDKFHQLLHELVEKNELNTGHIYFQVTRGTSPRAHQFPENTVKPVIIGYTKENPRPLENLEKGVKATFVEDIRWLRCDIKSLNLLGAVLAKQEAHEKGCYEAILHRNNTVTEGSSSNVFGIKDGILYTHPANNMILKGITRDVVIACANEINMPVKEIPFTTHEALKMDELFVTSTTSEITPVIEIDGKLIRDGKVGEWTRKLQKQFETKIPKPLHI

SEQ ID NO: 1131 - protein, 289 aa, Artificial Sequence
  Chemically synthesized
MSYTLWNDKIVDDNQVFINKEDRGYQFGDGVYEVIKVYDGEMFTATEHIDRFYASAEKIKLTVPYTKHKLHQLLHELVEANELKTGNLYFQITRGASPRNHLFPGDDVLPVLTGNVKEAPRSIENAQKGVKATFAEDIRWLRCDIKSLNLLGAVLAKQEAHEKGCYEAILHRGETITEGSSTNVFGIKNGVLYTHPADNFILSGITRGVVLACANEIGLPVKQEAFTKDKALQMDEMFVSSTTSEITPVIDLDGVAINGGEIGEWTRKLQKQFATKLPGSPAYNLTEYK

What is claimed is:

1. An isolated, synthetic, or recombinant polypeptide having a d-amino-acid transferase activity, wherein the polypeptide is the amino acid sequence of SEQ ID NO:220 or the polypeptide is selected from a group consisting of:
   (a) a polypeptide variant having d-amino-acid transferase activity wherein the polypeptide variant has at least about 85%, 86%, 87%, 88%, 89%, 90%, 91%, 92%, 93%, 94%, 95%, 96%, 97%, 98%, 99%, or 100% sequence identity to the full length of the amino acid sequence of SEQ ID NO:220;
   (b) a polypeptide having d-amino-acid transferase activity and the amino acid sequence encoded by SEQ ID NO:219
   (c) a polypeptide having d-amino-acid transferase activity wherein the polypeptide is a variant of the amino acid sequence of SEQ ID NO:220 and at least one mutation of SEQ ID NO:220 selected from the group consisting of: D2A, D2D, D2F, D2G, D2H, D2I, D2N, D2Q, D2R, D2T, D2V, D2Y, Y6C, Y6F, Y6H, Y6L, Y6M, G9A, N10R, N10S, N10T, N10W, G12A, L14L, L14V, T18W, V19T, P20S, N40N, G41G, G41Y, V42M, V42V, A45L, L46A, L46H, D47W, N55L, S56S, A57M, E61D, E61R, E61Y, I62C, I64H, L66G, L66L, E69Y, K72M, K73L, T74A, T74L, T74M, T74R, T74V, N76C, E77R, Y79R, Y79V, S80L, S80R, V82A, G85D, G85G, V93A, V93G, V93L, V93Y, G98A, S101Q, S101S, V103T, A106G, A106W, P108C, P108F, P108T, N110A, P117W, N118A, N118G, N118K, N118R, I120L, K126K, K126Q, K126R, I127M, K128L, K128R, K128S, L129I, L129V, I130M, T131T, M132A, M132R, M132Y, D133E, D133L, D133N, F137W, L138L, P149P, N150S, I152V, R156A, R156W, G161G, H163K, H163R, A165T, H168A, E171R, E171S, T172I, C176G, A177S, H182G, K185R, K185T, N186S, S205A, Q209S, V212E, R213W, I216T, P217H, P217V, D219F, E220V, R221E, F223C, S226P, L228F, V234A, V236T, S238S, G240G, T241C, T241R, L242F, E248F, D250E, G256K, K257V, E260G, L262R, K263M, I265L, D267G, D267R, E268S, L270G, L270S, L270W, R271S, I274W, G278S, Y279C, T280N, P281W, E282G, W283A, W283E, W283G, W283R, W283S, W283T, W283V, S284R, R285F, V286G, and V286R; or,
   (d) a polypeptide having d-amino-acid transferase activity wherein the polypeptide is a variant of the amino acid sequence of SEQ ID NO:220 and a combination of mutations of SEQ ID NO:220 selected from the group consisting of:

| Number/designation | Mutation |
|---|---|
| 1 | P20S-N118G |
| 2 | T74V-V93G-L270W |
| 3 | P20S-T74V-L270W |
| 4 | T74V-L270W |
| 5 | P20S-K73L-T241R-L270W |
| 6 | K73L-V93G-V236T-T241R |
| 7 | P20S-T74V-V236T |
| 8 | P20S-K73L-V93G |
| 9 | K73L-V236T |
| 10 | P20S-L270W |
| 11 | 2N-P20S-K73L-V93G-N118G |
| 12 | P20S-T74V-N118A |
| 13 | P20S-V236T |
| 14 | P20S-T241R-L270W |
| 15 | P20S-T241R |
| 16 | T74V-V93G-V236T-T241R |
| 17 | P20S-K73L-T74V-L270W |
| 18 | P20S-V93G-V236T |
| 19 | P20S-K73L-T74V-T241R-L270W |
| 20 | P20S-K73L-L270W |
| 21 | T74V-V93G-N118G-V236T-T241R |
| 22 | P20S-K73L-210A (SILENT-GCC → GCT)-V236T |
| 23 | N118A-L270W |
| 24 | P20S-58K (SILENT AAG → AAA)-L270W |
| 25 | P20S-V93G-N118G |
| 26 | P20S-V236T-T241R |
| 27 | P205-P117W-N118A-V236T-L270W |
| 28 | V93G-V236T |
| 29 | V236T-L270W |
| 30 | P20S-N118G-L270W |
| 30 | P20S-N110A-N118G |
| 31 | N110A-N118G-T241R-L270W |
| 32 | P20S-T74V-V93G-N110A-N118G-V236T-L270W |
| 33 | V93G-N110A-N118G-V236T |
| 34 | P20S-T74V-N110A-N118G |
| 35 | N110A-N118G |
| 36 | P20S-V93G-N110A-N118G-T241R |
| 37 | N110A-N118A-L270W |
| 38 | P20S-N110A-N118G-L270W |
| 39 | N110A-N118A-V236T-T241R |
| 40 | N110A-N118G-L270W |
| 41 | V93G-N110A-N118G-T241R |
| 42 | P20S-V93G-N110A-N118G |
| 43 | V93G-N110A |
| 44 | P20S-N110A-N118G-V236T |
| 45 | T74V-N110A-N118A-V236T |
| 46 | P20S-K73L-T74V-N110A-N118G-V236T-T241R |
| 47 | 86E (SILENT GAG → GAA)-N110A-N118A-V236T |
| 48 | T74V-N118G |
| 49 | P20S-T241R-L270W-277T (SILENT ACA → ACG) |
| 50 | T74V-N118A-L270W |
| 51 | P20S-K73L-N118A-L270W |
| 52 | P20S-V93G-T241R |
| 53 | T74V-V93G-N110A-T241R |
| 54 | V93G-N110A-N118A |
| 55 | P20S-T74V-V93G-N110A-N118G-T241R |
| 56 | T74V-N110A-N118G-L270W |

| Number/designation | Mutation |
|---|---|
| 57 | P205-231A (SILENT GCG → GCA)-V236T |
| 58 | V93G-V236T-T241R. |

2. A protein preparation comprising the polypeptide of claim 1, wherein the protein preparation comprises a liquid, a solid or a gel.

3. An immobilized polypeptide comprising the polypeptide of claim 1, wherein optionally the polypeptide is immobilized on a wood chip, a paper, a cell, a metal, a resin, a polymer, a ceramic, a glass, a microelectrode, a graphitic particle, a bead, a gel, a plate, an array or a capillary tube.

4. An enzyme mixture or cocktail comprising
  (a) the polypeptide of claim 1, and one or more other enzyme(s);
  (b) the mixture or cocktail of (a), wherein the one or more other enzyme(s) is another transferase, e.g., transaminase, e.g., d-amino-acid transferase, and/or oxidoreductase, e.g., dehydrogenase, e.g., d-amino-acid dehydrogenase, a mannanase and/or a glucanase, cellulases, lipases, esterases, proteases, or endoglycosidases, endo-beta.-1,4-glucanases, beta-glucanases, endo-beta-1,3 (4)-glucanases, cutinases, peroxidases, catalases, laccases, amylases, glucoamylases, pectinases, racemases, epimerases, isomerases, oxidorecuctases, reductases, oxidases, phenoloxidases, ligninases, pullulanases, arabinanases, hemicellulases, mannanases, xyloglucanases, xylanase, a mannanase and/or a glucanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases.

5. A beverage or beverage precursor comprising the polypeptide of claim 1, or the enzyme mixture or cocktail of claim 4.

6. A method of beverage production comprising administration of the polypeptide of claim 1, or the enzyme mixture or cocktail of claim 4, to a beverage or a beverage precursor, wherein optionally the beverage or beverage precursor is a wort or a beer.

7. A feed, food, food or feed additive, food or feed supplement, or dietary aid or diet supplement comprising the polypeptide of claim 1, or the enzyme mixture or cocktail of claim 4, wherein optionally the feed, food, food or feed additive, food or feed supplement, or dietary aid further comprises a carrier selected from the group consisting of a grain germ, a grain germ that is spent of oil, a hay, an alfalfa, a timothy, a soy hull, a sunflower seed meal and a wheat midd, and optionally the carrier comprises grain germ that is spent of oil, or optionally the transferase, e.g., the transaminase, e.g., the d-amino-acid transferase, and/or the oxidoreductase, e.g., the dehydrogenase, e.g., the d-amino-acid dehydrogenase enzyme is glycosylated to provide thermostability at pelletizing conditions, and optionally the delivery matrix is formed by pelletizing a mixture comprising a grain germ and a transferase, e.g., a transaminase, e.g., a d-amino-acid transferase, and/or an oxidoreductase, e.g., a dehydrogenase, e.g., a d-amino-acid dehydrogenase, and optionally the pelletizing conditions include application of steam, and optionally the pelletizing conditions comprise application of a temperature in excess of about 80° C. for about 5 minutes and the enzyme retains a specific activity of at least 350 to about 900 units per milligram of enzyme.

8. A chewing gum, lozenge or candy comprising the polypeptide of claim 1, or the enzyme mixture or cocktail of claim 4.

9. A chimeric transferase, e.g., transaminase, e.g., d-amino-acid transferase, and/or oxidoreductase, e.g., dehydrogenase, e.g., d-amino-acid dehydrogenase comprising the polypeptide of claim 1 and at least one heterologous binding domain; wherein optionally the binding domain comprises: a NAD, a NAD(P), a calcium, a thiamine, a FAD, a zinc, a DNA and/or a lipoyl binding domain.

10. A dough, bread or baked products and/or dough, bread or baked product precursors comprising the polypeptide of claim 1 or the enzyme mixture or cocktail of claim 4.

11. A method of making a pyruvate and/or a D-glutamate comprising:
  (a) providing a D-alanine and a 2-oxoglutarate;
  (b) providing the polypeptide of claim 1; and
  (c) contacting the polypeptide of (b) with the D-alanine+2-oxoglutarate under conditions wherein the polypeptide catalyzes the reaction D-alanine+2-oxoglutarate<=>pyruvate+D-glutamate.

12. A method of making a 2-oxo acid comprising
  (i) (a) providing a D-amino acid+$H_2O$+acceptor;
  (b) providing the transaminase polypeptide of claim 1; and
  (c) contacting the polypeptide of (b) with the D-amino acid+$H_2O$+acceptor, under conditions wherein the polypeptide catalyzes the reaction: D-amino acid+$H_2O$+acceptor<=>a 2-oxo acid+NH3+reduced acceptor; or
  (ii) the method of (i), wherein the acceptor is a benzoquinone is
  (iii) the method of (ii) wherein the benzoquinone is a 1,2-benzoquinone or a 1,4-benzoquinone, or ubiquinone, ubidecarenone or coenzyme Q.

13. A method for transferring an amino group from an amino acid to an alpha-keto acid comprising
  (i) (a) providing an amino acid;
  (b) providing the transaminase polypeptide of claim 1; and
  (c) contacting the polypeptide of (b) with the amino acid under conditions wherein the polypeptide catalyzes the conversion of the amino acid to an alpha-keto acid; or
  (ii) the method of (i), wherein the transaminase activity comprises catalyzing the conversion of a racemic amino acid mixture to a substantially optically pure alpha-keto acid.

14. A method for transferring making an amino acid from an alpha-keto acid comprising
  (i) (a) providing an alpha-keto acid
  (b) providing the transaminase polypeptide of claim 1; and
  (c) contacting the polypeptide of (b) with the alpha-keto acid under conditions wherein the polypeptide catalyzes the conversion of the alpha-keto acid to an amino acid;
  (ii) the method of (i), wherein the transaminase activity comprises catalyzing the conversion of a racemic alpha-keto mixture to a substantially optically pure D- or L-amino acid; or
  (iii) the method of (i) or (ii), wherein oxaloacetate is converted to an aspartate, or α-ketoglutarate is converted to glutarate, or an α-ketoisovalerate is converted to an L-valine; or the transaminase activity is an omega transaminase activity that catalyzes the conversion of isobutylamine to isobutyraldehyde.

15. A method of catalyzing the conversion of an amine to a ketone comprising
  (i) (a) providing an amine;
  (b) providing the transaminase polypeptide of claim 1; and (c) contacting the polypeptide of (b) with the amine under conditions wherein the polypeptide catalyzes the conversion of an amine to a ketone, wherein the amine is not in or from a tryptophan (with the proviso that the second amino acid is not tryptophan, or with the proviso that the amine is not in or from a tryptophan);
(ii) the method of (i), wherein the transaminase activity comprises catalyzing the conversion of a chiral amine to a ketone; or
(iii) the method of (i) or (ii), wherein the amine is a ω-amine.

16. A method of catalyzing the synthesis of an amino acid comprising
(i) (a) providing amino acid and a keto acid, wherein the amino acid is not tryptophan;
(b) providing the transaminase polypeptide of claim 1; and
(c) contacting the polypeptide of (b) with the amino acid and keto acid under conditions wherein a second amino acid and a pyruvate is produced, wherein the second amino acid is not tryptophan (with the proviso that the second amino acid is not tryptophan); or
(ii) the method of (i), further comprising reacting the pyruvate with an acetolactate synthase enzyme under conditions appropriate to produce a compound that does not react with transaminase enzyme;
(iii) the method of (ii), wherein the compound that does not react with transaminase enzyme is acetolactate or acetoin; or, the first amino acid is alanine or L-aspartate; or, the keto acid is 2-ketobutyrate or tri-methyl pyruvate; or, the second amino acid is 2-aminobutyrate or tert-leucine.

17. An isolated, synthetic, or recombinant polypeptide having a d-amino-acid transferase activity comprising SEQ ID NO:220.

18. The polypeptide of claim 1, further comprising at least one amino acid residue substitution, and the polypeptide retains d-amino-acid transferase activity.

19. The polypeptide of claim 18, wherein the amino acid substitution comprises replacement of an aliphatic amino acid with another aliphatic amino acid; replacement of a serine with a threonine or vice versa; replacement of an acidic residue with another acidic residue; replacement of a residue bearing an amide group with another residue bearing an amide group; exchange of a basic residue with another basic residue; or, replacement of an aromatic residue with another aromatic residue, or a combination thereof.

20. The polypeptide of claim 19, wherein the aliphatic residue comprises Alanine, Valine, Leucine, Isoleucine or a synthetic equivalent thereof; the acidic residue comprises Aspartic acid, Glutamic acid or a synthetic equivalent thereof; the residue comprising an amide group comprises Aspartic acid, Glutamic acid or a synthetic equivalent thereof; the basic residue comprises Lysine, Arginine or a synthetic equivalent thereof; or, the aromatic residue comprises Phenylalanine, Tyrosine or a synthetic equivalent thereof.

21. The polypeptide of claim 17, wherein the amino acid sequence is lacking a signal sequence, a prepro domain, or a binding domain.

22. The polypeptide of claim 21, wherein the binding domain comprises, or consists of, a NAD, a NAD(P), a calcium, a thiamine, a FAD, a zinc, a DNA and/or a lipoyl binding domain.

23. The polypeptide of claim 17, wherein the amino acid sequence further comprising a heterologous sequence.

24. The polypeptide of claim 23, wherein the heterologous sequence consists of: (A) a heterologous signal sequence, a heterologous domain, a heterologous binding domain, a heterologous dockerin domain, a heterologous catalytic domain (CD), or a combination thereof; (B) the sequence of (A), wherein the heterologous signal sequence, binding domain or catalytic domain (CD) is derived from a heterologous enzyme; and/or, (C) a tag, an epitope, a targeting peptide, a cleavable sequence, a detectable moiety or an enzyme.

25. The polypeptide of claim 24, wherein the heterologous sequence or the heterologous binding domain comprises: a NAD, a NAD(P), a calcium, a thiamine, a FAD, a zinc, a DNA and/or a lipoyl binding domain.

26. An isolated, synthetic, or recombinant polypeptide having the amino acid sequence of SEQ ID NO:220, and having d-amino acid transferase activity and an enzymatically active fragments thereof.

* * * * *

UNITED STATES PATENT AND TRADEMARK OFFICE
CERTIFICATE OF CORRECTION

PATENT NO. : 8,709,772 B2
APPLICATION NO. : 12/810057
DATED : April 29, 2014
INVENTOR(S) : David P. Weiner et al.

It is certified that error appears in the above-identified patent and that said Letters Patent is hereby corrected as shown below:

On the Title Page, References cited section (Other Publications) in 5th citation, delete "Purificatioin" and insert --Purification--, therefor.

In the Claims

In Column 357, Line 39 in Claims, delete "162C, 164H" and insert --I62C, I64H--, therefor.

In Column 358, Line 40 in Claims, delete "P205" and insert --P20S--, therefor.

In Column 359, Line 5 in Claims, delete "P205" and insert --P20S--, therefor.

In Column 359, Line 29 in Claims, delete "oxidorecuctases" and insert --oxidoreductases--, therefor.

Signed and Sealed this
Twelfth Day of August, 2014

Michelle K. Lee
*Deputy Director of the United States Patent and Trademark Office*